United States Patent 6,747,137 (NUCLEIC ACID SEQUENCES RELATING TO CANDIDA ALBICANS FOR DIAGNOSTICS AND THERAPEUTICS) - sequence listing, part 6

SEQ ID NO: 20051 - protein, 141 aa, Candida albicans
REKKYILLKENPIYSSTKHSKMNLIEDNFKNSAERIDKPSAYLIRKARHNYGELERAMTLKTVYVGNLSHFTTEEQIHELFLKCGAIDRIIMGLDRNKLTPCGFCFVIYRTEQGSLNAMKFLQSTILDSQSISIDLDPGFR

SEQ ID NO: 20052 - protein, 231 aa, Candida albicans
DEVTITTATTYFDFDYTQIQIMAKKISKHSRAARRGLIDTDTSNEAKSLESIHREKSDVKKSIIRTTIKNENLLNKKLELSKIKKSTTKKKTSALKHKLERSDKISGILATKIDQSIARAKYVQNARKSGWDKTNQSITLENHLAQELKSASGLGDEEEKKKELTQEELDKIEEDEYVKSIFAKKEEQKEEGEAEEETPNKSLANNRFALLDDIEDYRVLLGEEILGVLID

SEQ ID NO: 20053 - protein, 101 aa, Candida albicans
  UNSURE (61),(79): Identity of amino acid sequences at the above locations are unknown.
WVTQIGLCSPFVIAISNRGIKVLPSIFNAVILSALLSVANASVFATYKPLVALTQAGHGTXFLAYVDQKAITIYSIIIXLGFRLIGICGFIKLSTCCVLNW

SEQ ID NO: 20054 - protein, 339 aa, Candida albicans
  UNSURE (17),(18): Identity of amino acid sequences at the above locations are unknown.
CLGYTMDWPHTNYDCIXXAPASPWFLVRKGRLEQAKHALERLLSQSEHIPDKSIISQSMLTKIQMTIKEEDAVSAGSSIIECFKGTNFRRTRIAAFTWLIQNITGSSLMGYSTYFYQNAGVPVSMSFTFSIIQYCLGIVGTIGSWFLSQKCGRFTIYFYGLCAMTVLLLLTGGMGTSDKKSLSMAVGSMLLVYTFVYDLTIGPMCYCIVGEMPSSKLRAKTVMLARNLYNIAGIIVAIVTPYMLNPTQWNWKAKSAFLWAGFAILSAIWVYFELPETKGRTFAELDKMFEDKVPARKFKYTTPTTFDAGEMMEKMGNSGLKSIVHDTEHVESSHIETKA

SEQ ID NO: 20055 - protein, 201 aa, Candida albicans
ARVFPAQWWTIILFYFPRVHTSKMKDNMNYPSKRDRLTIRLSKSFPIRKKEKEISSTVNFAKRMSVLTPIFLKKFNLKKTIEENNETVKPQILSIPENPRENAMKPTDNLNLPPVITIGSSGLDPVRGGISPEQSLYTVIRSYNKSLGDELNIEVGDKAVILEKHSDGWCKIRLVRMGKDYYNHQLSLDIGLVPKMCLQKI

SEQ ID NO: 20056 - protein, 130 aa, Candida albicans
NQARDNEWERNHLPLTQGSQDIKKATIFTQITILASRTFKNLYRNPRLLLAHYVLSLAVGLFCGYLYYDVSNDISGFQNRLGLFFFLLAFFGFSALTGLHSFATERIIFIRERANNYYNPLSYYVSKLFL

SEQ ID NO: 20057 - protein, 286 aa, Candida albicans
FVDQEDHLILTLTVYETVLNSALLRLPRDMSFGQKQARVIEVLSELRILGIKDRVIGSDFKRGISGGEKRRVSIACELVTSPSILFLDEPTSGLDSYNARNVIESLVKLSRDYERTVVFTIHQPRSNIVSLFDKLLLLSEGDLIYSGEMIKCNDFFTKNGYKCPPGYNIADYLIDITVDHNKIVKVSDADSSVAIASSSDLHDANVHAAFLSTRSESQVDTTSEWEHFAVHRDEYNTDIIGHRKSKGGEEETILRLRNKLPTLFIESPSAFEIKQEITNGKEIIYR

SEQ ID NO: 20058 - protein, 336 aa, Candida albicans
SPPISTQTMNGNLFVAWTVISCLKQLTMGLKVENNQDLEATFTRIKRSLVHQDIFEINPQITERAKPGHGNDGDDDNKECPPCFNCNLPNFECTQFSQCNTFTGMCECQDGFGGNDCSEPLCGSLGDGNSKRPVRKKKQCACKSGWSGINCNLCERDDVCDQFMPEGLKGTCYREGIIVNKFHQMCDVTNPKILSILDGKIPQATFSCNKTSENCNFQFWIDQVESFYCDLNKCKLDYDLNANTTHYNCEEVACKCLPDRMLCGKAGSIDISEFLTETIRGPGDFTCDVATKKCRFSEPSMNDLIQSVFGDPYITLQCKSRECIRFHTRRWKDQRR

SEQ ID NO: 20059 - protein, 154 aa, Candida albicans
LGWFDNGAQCFPSKLFWFWCCIMCLLPLEMLIVGILVKEPGTSTMVGVLLLLMSLLFAGLFINSEDLNMQIKWLEWISVFHYAYESLSINEVKDLILREKKYGLSIEVPGAVILSTFGFDVGAFWKDISFLGGLSAVFLGLGYIFLFYFTVEKR

SEQ ID NO: 20060 - protein, 1362 aa, Candida albicans
GRRRGTLDETPIVDDNGFLHEDKPRRKRVGASEPIDSNEPTSLLPKQNLSKKFKRVSVALQNTRTSGESYNFRNVFQNNVDQANRTATQDNTAPKLERKSTYYRKLQEKKLQSSQEQQGTEVENMVISNDQHSEASSISTRASSTHTDTSGRDDEQDDNLVKKNSTNSSSNFVFSNNNLPSSYNLGGSKVNDDIPIRKDLIRENKAQVQQDAIDRERLQMYNNSTAMSEEGGLNIVYKDANTTSDDTYLKPPSPTKSEEKEDNLSDFFIRALHSFDSSTLQSKSDASICLSFEKNDIAFLHTIDESGWGEVTLLETLQTGWIPMNYFSLVVTSSDDEEDEDDSYEDNDDDDSNKIPNNHYLKPLLHACGQSLSNPLSHKDRRNKYTFSIRVINSIRDGVRLLLQQTDCLSRSNELVTKRPIVRKSRKSLLADWYNLMVKANEFKGTSNYNKIEILTLMVYQVSRKAVSFLEIWSAESKEIITRDHTGKKLYDDLNDCPLLKTPPLAKQRITEIHGVLFSYLGLIIGRLDLIEHNQIGCDMLETLAHQIILLLRELLFVSRTGSEYSKDKPRELDSSLDGLLSLVSDLVASVKNLVVRTVNETEEDRIHKFGGPQLNGARDYYYTPEGGELLQIASRMVKAISVTVASIRKLLEVTGDFKLSSERSYPDYSKMRIEPQEFIKKCSQGITKLKDMPIQQPNGATSTSNSGGIKAYKANRYSMIRAGKTGDLGLTENGVNYLQSLNNEDGNGNNDVDELDGSSPFTLSAPEFKPFTSEGGNESNNDANINANINNELSVDSNGNLLGGSFKGLVYTLTNEDLPPEYFFVSTFFICFRSFSTGIDLIEELITRFQVGYVSNDINIDLKLKKRRKLVAKLIQLWMESYWNHEADYNLLTTLINFFNEGMSDYLPLDAIRLIDIGARLSSRPLVENRSRRIKDTKQLVNRSITNAAKLPRKTGSILGDEINRYSMIDSYSLSKINSTSSSNSTTSSSGHSASLPMPLGPTSTSKTSLLTSSQLETIEKVNLTYRAILGNSWCSQKYINSVKYIPLDLSVLMPNFYIICDQSWVLSNYRPNLLDFNGLEIAKQLTLLESYIFCSIKPDELLNQNYTTKRAHLKLAPNVRLSLLFTNCLSGYVIESILQPNITIKLRISMVKIWLKIAISCLYLRNFNSLAAIITALESHLITRISSIWIKLEDKYTELYDYLSSIIHPEKNYRVYRNKLRNFLNSPMGLETPPIPIVPYFSLFLQDLTFINDGNPNYRKANTFLNQKLINIDKYLKITRIIADIECLQISYLDDPNIVGNGDGNSLMENGDDKPNYTINPVAPLQELILLELWKICQLNKTEEDRAWKLSCKIQPRDVS

SEQ ID NO: 20061 - protein, 328 aa, Candida albicans
RTLTSQTNNNMASRDLPHSLNDLAFGWIKHLKEEIIINKNSQQLFDEDFQPDEDVTKETKVKLNNLWPAFASGAGLFADGYVNNSIGIVMACLKILYGDEFTKSNAISNIGSIGFVGTVVGQLSFGYISDRVARKGGMMTANIMLIAFTLLCAVGSWGTTIQGFFACLTVWRFCLGVAIGAEYPTSSVIASEFANQLPAGKRNRYFIWFTGFMIDFGFVVSAFVPFVLLWIFTEKHLRALWRVSIGLGAILPTALFFIRLKMKDSTSFEKLHMKNVRYRDYPWWLIVKFYWFRLTIVSMIWFIYNFSLYSFGTFNAIILGQIIPDAPL

SEQ ID NO: 20062 - protein, 332 aa, Candida albicans
  UNSURE (325): Identity of amino acid sequences at the above locations are unknown.
PIPFFNRPIQISYSLCSLIYLLTFLPIYSIHLVSFSFHFLIYLILSYLFYLVTHLYIYLFLFETSTDFTNMSTRDLPHSFSELSYGWVKRIRAEFTVGKSKEQLLAEDYHSTTDEDSEVVTSVKANSLWPAFASGAGLFSDGYVNNSISTVLFCLKKIYPDEITKSNAINNIASIAFVGTVVGQLGFGYISDRIARKGGMMAANVMLIFFTLMCAVGSWGVTVQGFFACLTVWRFFLGVAIGAEYPTSSVIASEFANQLPPGKRNRYFSWFTNAMIDLGFVVSAFVPFVLIWISTEKHLRALWTVAIGLGVIPPLSLFFMRLKMXNSSSFHK

SEQ ID NO: 20063 - protein, 155 aa, Candida albicans
RPVVFGIFATLGEFGPGGNIGLLASKTSATPIRGQYYGIAAAMGKIGAFVGTWIFPAIQRRYASKTNPDLELQVPFYLSSGLCIFSALLTFFLCPHVGQDAINREDKEFVEYLRKNGFDVSKLGEDSSSVDVDVVKDTDSAEKISETIEVGQKLA

SEQ ID NO: 20064 - protein, 309 aa, Candida albicans
ILIIEMAFWRTMFAIGCLWPLSVFYFRLKMVTSELYTKSGIKQRAPYWLALKYYWPRLIGTCVAWFLYDFVTFPNGIYSAGIISNVIPKLEKNNLEKIAEWNLLLGAIALPGVFVGAYVVDILGRKYTMMIGFCGYIVFGLIVGCGYHQIKPITGLFIVFYGLMMSCGNFGPGNNMGLTSSESFATPIRGTAYGISAAIGKVGAVVGTKTFSPIQKNLGDKWTFIIAAICGLAGVLVTFIFIPHLKDEDLLEEDVKFKNYLIDNGWKGKFGIQEYDEEEDLEGSSEDSSDGEIVKNNTKNDVEKVDALK

SEQ ID NO: 20065 - protein, 198 aa, Candida albicans
LVRYYHCLKKIYGDEFIKSNAMNNIGSIGFVGTVVGQLSFGYISDNFDRKTGMLTANVMLIFFTLMCAVASWGTTVQGFFACLTVWRFFLGIAIGAEYPTSSVIASEFANQLPSGHRNRYFSWFTNAMIDFGFVVSSFVPLVLLWIFTPRHLRAVWRLSIGLGVIPPLILFFIRLKMDNSKSFKKMNMSSPRRWKDPH

SEQ ID NO: 20066 - protein, 533 aa, Candida albicans
  UNSURE (509): Identity of amino acid sequences at the above locations are unknown.
TTHTRKMRSITSRTEDHLHNVISHRSEVRSIDPQHNAGDVELLAQIGYKQELRRHYSTFQVFGIAFSIMGLLPSISSVLSIGLEGGPAALVWGWILASIFILCVGTSLAFLGSAIPTSGGLYYYTNYYCPDAFRVPLSFMIGCSNSLGLIGGLCSISYGFAVQVLSAVYIQQDGAFEITRAKCYGIFVACVVSNAIICCLATKQAALLQTISIIVNVFLVLLFLIAVPVGTGHGFNSASYIFGTLINNRDYGTAWSFFLSWLPAIWTIGSFDSTIHCSEEAKNAQRAIPVGIIGSISACGILGWAICIVCAACIKDGDVSRVLQSDTGSAMAQIIYDALGKKWAVAFMSLIAVGQYLMAVSEMIALSRQIWSFARDDGLPVVYNFVKYVNPKIKVPIRASIFAGVLSTLVGLLVLIGDAGSGALFSLAIASLQLSWGLPVLLVLLPYGRRKFISGPFHFGFKTNTAINLVTICWSVYAIVLSMFPDSRKVDKASMNYTVVINVGVWLLXLIYYFVWGYRFYSGPKSNLDKDDD

SEQ ID NO: 20067 - protein, 475 aa, Candida albicans
YAAPSTRLVKTPAGLVWGWFLSSIFILCIGISLAFLGSAIPTSGGLYYYTNYYCPDAFRVPLSFMIGCSNSLGLIGGLCSISYGFAVQVLSAVYIQQDGAFEITNAKCYGIFVACVVSNTIICCLATKQAALLQTVSIIVNVFLVLLFLIAVPASKGGDFNSRSFIFSNFENSRDYGTVWSFALSWMPAIWTIGAFDSTIHCSEEAKNAQRAIPVGIIGSISACWILGWAICIVCAACIKDGDVSTVLESDTGSAMAQIIYDALGKKWAVAFMSLIAVGQYLMSVSIMIALSRQIWSFARDDGLPVVYNFVKYVNPKIKVPIRATMFAAVLGILLGLLVLINGTAGSGALFSLAVASNVLSWGLPVLLILLPYGRKRFIPGPFYFGSTISTLINIVSVGWTGYVIVLCMFPDSITVDKNSMNYTVVINVGVWLLALIYYFVWGYRFYTGPKSNLEEDFVEGVSTGNVDEVLNEKV

SEQ ID NO: 20068 - protein, 765 aa, Candida albicans
VIRYHICILSYNTVFEDMKNLSVFPFLTRIMYDASLEDEYYRQMRQKSSSISAFKVGLVAAMGGFLYGYDTGLINDLLEMEYVYTHFPSNNKSFTSHERSILVAILSLGTFIGALIAPLASDRYGRKFSIMMSSGLIFITGNILQIASASIALMCVGRFVSGVSVGILSAIVPLYQAEVSPKWLRGSVVFTYQWSITAGLLVSSAVCQGTRKINNSESYRIPIGLQFLWALILFFGMSFLPESPRYYVQQDNLQLALDSLCKLRKLPPDDDDLIEELVDIKANYDYELSYGKTTVLDCFKSGGGRHKQGLRMLTGIGVQFFQQCSGINFIFYYGVNFFSSTGINNYYIMSFITYLVNVIFTVPGIMMIDVVGRRPLLFWGGVGMAVCNFIIAIAGVSVKNDEVNGILCVSFACVFIAFFASTWGGCTWALCSDIYGISIRQKAVALTAATNWLVNFIFAFITPYLIDTGQHTAAIGSKIFFIWGSFNACGAIFVFFTVYETKGLKLEEVDYMYVHCDNARVSTKFISTKIDFAHLDENYNPIPMTQLPDSTSSNEMYHDKGSDENSSPQQLPHYHQQQPLYNGEDQNNLTIIPYDNSLTISSVNSIEERRDSIPSTNGLSFTSSSQSHPQSNSYSHSNSHSATYRSKSHNSMISNDYQLYLESIQREYSQHYQNSSAMIKQLSRNSRNNGSDQEERHEPIQKQEIIDSPLNINSINHINNIPTTVIATPFFAHPPSDSDSSDDEEEEEVVVEQEGVKINDVTTIK

SEQ ID NO: 20069 - protein, 135 aa, Candida albicans
SSPSIVYTCIIFTKMSANIQALMKSYVNFDEHTSGSAARGILIGMFAAFGGFLFGYDTGTISGVLSMDYVKARFPNNKTDFTSGESSLIVSILSVGTFVGSLIAPLFSDRIGRIWTLILSTLIVFNLGVLLQTVA

SEQ ID NO: 20070 - protein, 358 aa, Candida albicans
RPLELAQAIRTSTKLLKTTAFVTIYQAGEGIYETFDRVTVLYDGHQVYYGPANKAKKYFEDMGWECPPRQSTAEFLTAITDPIGRFPRAGWENKVPRTAQDFEHYWLNSPQYQELMQEIKDYNDEIDEDETRSKYYQSIQQEKMKGSRTKSPFTISYLEQLKLCFIRSYQRILGDSAYTITLMFASVAQAFVAGSLYYNTPDDVSGAFSRGGVIFFAVLFMSLMGLAEISASFSSRPILMKQKNYTMYHPSADSLSNFVMSIPISIFINTFFVIILYFLSNLARDAGKFFICYLFVIMLHLTMKSMFQAIAAINKSIAGANAMGGILMLASLMYSSYMIQRPSMHPWFKWMSYINPVL

SEQ ID NO: 20071 - protein, 305 aa, Candida albicans
EQFNMSSEDIGSSSSSLQEYVGQQQHNKIQPSTDDDYNEDDYESRRLHLVRTVSSINHHNFDEKFDTISREISRQVTNKEGEFQLRLDEFNLAKILANFVYFAKKQGIVLRKSGITFQDLCVYGVDESFDIAPTVTDLLKGPVGAVQAILSHMKTPPRKILKNLNGFAKPGESVLVLGRPGAGCTTFLKALSGTDFDLYKGVTGDIRYDGLPQKEMLKLFKNDLVYNPELDVHFPHLTVDQTLTFAIACKTPEMRINGVTRDEFINAKKEILATVFGLRHTYHTKVGNDFVRVFPSSPRGWKIPR

SEQ ID NO: 20072 - protein, 266 aa, Candida albicans
  UNSURE (214): Identity of amino acid sequences at the above locations are unknown.
TSKILNNLSFDIECGQLVAIMGGSGSGKTTLLNTLSQRTNINNKNLGFSGSVTYETSSLNKHIKHAYLLQTDIFLPGLTVWETLSTQADLRLPSHVTKQEKIELIEYILDVLELSHLKNTYVASFSLNASTLSGGEQRRVSLAIQMLSKPAILFLDEPTTGLDTSSSLKLVHVLKKLASPEYGITIILSIHQPRPEIGQLFDKICLLTTGGRLXYFGNLANAQMYFNNLNFLGRDSDESSKHILGIHYGFISEKTQHHLKKEQQTF

SEQ ID NO: 20073 - protein, 277 aa, Candida albicans
  UNSURE (15),(71),(274): Identity of amino acid sequences at the above locations are unknown.
TGAQNGMFGPFLSSXIAAPLINQILEKAGLRDIYEVREKLSITYHCSLLILPQIIFEVIYMIIGGTIMFVXLYFLTQVSTVALHSGMFYFSQAIFLQTFAVSFGLMVLYVSPDIESASVIVSFLYTFIVSFSGVVQPVNLMPGFWTFMNKVSPYTYFIQNLVSSFLHDRTIRCNAKELSYFNPPSGQTCKEFASAFISRNGGYLVDEGATSNCGYCNFSNADQYLLTIGAKFSYRWRNIGFFCVYIIFNISVCLVLYYFLRYRQYLSVFDRRAXSLY

SEQ ID NO: 20074 - protein, 113 aa, Candida albicans
IQQDVDRSCFNLFLDVKFLNHCKFKLFKMSSTNSTENHAVEEKYEDPQQQQQQQQQQQQQQQQKDALAKKPMSAYIGISIMCVLIAFGGFVFGFDTGTISGFINMSDLVERFV

SEQ ID NO: 20075 - protein, 506 aa, Candida albicans
RNILVLVFCVFLIAFGGFVFGFDTGTISGFINMTDFLERFGGTKADGTLYFSNVRTGLLIGLFNVGCAIGALFLSKVGDMYGRRVGIMTAMIIYIVGIIVQIASQHAWYQIMIGRIITGLAVGMLSVLCPLFISEVSPKHLRGTLVYCFQLMITLGIFLGYCTSYGTKKYSDSRQWRIPLGLCFAWALCLLGGMVRMPESPRYLVGKDRIDDAKISLAKTNKVSPEDPALYRELQLIQAGVERERLAGKASWGALITGKPRILERVIVGGMLQSLQQLTGDNYFFYYSTTIFKSVGLNDSFETSIILGVINFASTFVGIYAIERLGRRLCLLTGSVAMSICFLIYSLIGTQHLYIDQPGGPTRKPDGNAMIFITALYVFFFASTWAGGVYSIVSELYPLKVRSKAMGFANACNWLWGFLISFFTSFITDAIHFYYGFVFMGCLVFSIFFVYFMIYETKGLTLEEIDELYSTKVVPWKSAGWVPPSDEEMVRAKGYTGDIHADEEQV

SEQ ID NO: 20076 - protein, 418 aa, Candida albicans
TFVFPAGCVEYVQIASQHAWYQVMIGRIITGLAVGTLSVLCPLFISEVSPKHLRGTLVCCFQLMITLGIFLGYCTTYGTKTYSDSRQWRIPLGLCFAWALCLLGGMVRMPESPRYLVGNDRIEDAKISLAKTNKVSPEDPALYRELQLIQAGVERERLAGSASWKSLITGKPRILERVFVGAMLQSLQQLTGDNYFFYYSTTIFKSVGLNDSFQTSIIIGVINFASTFVGIYAIEKLGRRHCLLIGSVAMSICFLIYSLIGTQHLYIDKPGGASRKPDGDAMIFITALYVFFFASTWAGGVYSIMSELYPLKVRSKAMGIASASNWLWGFLISFFTSFITDAIHFYYGFVFMGCLVFSIFFVYFMVYETKGLTLEEIDELYSTKVVPWKSAGWVPPSEEEMATSTGYAGDAKPTEEHV

SEQ ID NO: 20077 - protein, 215 aa, Candida albicans
  UNSURE (180),(200): Identity of amino acid sequences at the above locations are unknown.
KCIDLREFFKKKMGSSTNNTQSKATPSVLENEVNSSKSSVVSSTSSAKGLLRETTNHGTMETSSVQISESESRPSKMVLVLTLASSISGFMFGYDTGYISSALVQIGTDLSNKILTSGEKEFITSATSLGALPGAVVGGVLPNLIGRRRVLLGSNIIFVVGTIIQLAARTVWTMITGRIXLGWGVGIASLIAPLMISDLXPAKYPGKINCYQCHI

SEQ ID NO: 20078 - protein, 553 aa, Candida albicans
ITYIYSIMGGFIYNIFKRTTTAGLTGRKLRAAVTITATLGFSLFGYDQGLMAGLISAEQFNWEFPATKDNSVIQGAVTASYELGCFFGAIFALLRGDALGRKPIIFFGATIIILGTIISVTPFRPHWPLGQFVVGRVITGIGNGMNTATIPVWQSEMSKPENRGKLVNLEGAVVAFGTFIAYWLDFGLSYVDSSVSWRFPVAFQIFFALWVIFGIIQLPESPRWLISKDRKPEAFEVLAALNDTTPDDDAIVAEASVIIDAVRRNAKVQAGFKDLFTGGKTAHFQRMLIGSSTQFFQQFTGCNAAIYYSTLLFYETVFHHTKYRLSMILGGVFATIYALATLPSFFLIDTLGRRNLFLIGAIGQGISFLISFACLINPTEQNAKGAAVGIYLFIVFFAFTILPLPWIYPPEINPLRTRTTASAVSTCTNWLTNFAVVMFTPPFISASGWGCYLYFAVMNFLFVPIIFFFYPETAGRSLEEIDIIFAKAYVEKRQPWRVAATLPKLSLQEVEDESKSLGLYDDDFEKDNFETKEDVSDGTASNSNGVFEKPENV

SEQ ID NO: 20079 - protein, 500 aa, Candida albicans
YTKERHHHARFLAGRMESNNKMEKESSLENSRNSSINEFDDSTLSNKVHTFLGYSGTRLNFIISTFAGVGFFLFGYDQSLIGSLLTLPNFEETCPSILGPDDGVLQGTVVSIYEIGCFAGAIATIYCGNKFGRIKCMLIGCIIIIIGAALQASAFSVGHFIVARIVTGVGTGFMTSTVPVWQSELSRATTRGKLIMLMGSLITAGVATAYWVDFGFYFVSENDPKGISWILPIILQVIFPMMLLSVIFKVPESPRWLMSKKRVREARIVFSAIYNLPENDSEVTSQLAEIQSALELEEAESAGFNIRELVKQGPTRNFQRLSLACWSQIFQQISGINLITYYAGTIFEKYIHMSPFNARILAACNGTEYFLASLLGIVFIERVGRRKLLFFGAIGQALTMMALTIATWQADKQRAENGGGTGAGIAAAVFLFVFNSVFGVLYLGGTWLLPTEVSSLQLRAATAALSTSCNWLFNFMVVCIKFSFLLVQGLNFSILTFSRL

SEQ ID NO: 20080 - protein, 90 aa, Candida albicans
VMITPVAFQNIGYYTYTIFACINILIAPMIYIFYPETSGRTLEELDIIFSKTPIWKPWEVVAIEKETPKRDFTKDVEKPFTEHIDHVELD

SEQ ID NO: 20081 - protein, 325 aa, Candida albicans
MSMRIQFGLADKTKTEDQLANLKSNITLMVMLGSIGGALIAMKTVDFFGRIRALQIVCVVLIVGVIIQITSNSIGQLYAGKIIEGLAVGHTTSIGPVYLSEVAPSPIRGLATCIFSGAVYLGSMISYFTNYGVALHVPAEKNGHINKNQWRITLAPKLILSGLIFIMSFVFCIESPRWLLKTNKPDKAAENLSKLRRLPADHPYIIAEISDINEQVIAEKEATNHSSLLSNFKALVSNKSIAYRFFVISCGCQIIGQWTGANAVTVYASKLFSLIGVTGTGTLKMSAVLRVVKFISAYWSAFFLIDVIGRKRALYTGLSLQMTCI

SEQ ID NO: 20082 - protein, 439 aa, Candida albicans
FHFYLSQQFVSLSPNLLGEMATYIPVSGSFVQFITRWVSKSCGAANGWLYGWSWAITFGLELSIVGQVIQFWTDAIPLAAWISIFFVLLTALNLFPVKFYGEIEFWMASIKLTAVIGWIIYAFCMVCGAGKTGPVGFRYWRNGYAWGDGMIVLNNGKYAISFINGLINAVFTFQGTELVAITAGEASPKALKSAIRKVMFRILVFYVLCMLFIGLLVPYNDPKLTEDGGFTRNSPFLIAMENSGTKVLPHIFNAVIVTTIISAGNSTVYAGSRIFYGLAESGVAPKIFLSTTKAGVPYVAVLFTAAFGALGYLVVSNDGTVVFNWLLNIAATAGLVAWGFISVSHIRFMQVLKQRGISRDTLPFKAFFMPYSAYYAAIVVFTVALIQGFTVFWDFNATDFFTAYVSLIVFVVWWIMFHFFFFGFGKQAWKWSNVFIPVF

SEQ ID NO: 20083 - protein, 144 aa, Candida albicans
SKQLYINIMFEVGEKYPVESSSSSNDIESRGVQPITSLKDNKSIGMIEKDNDDLSCEQYSTCDEVKRDLKARHVSMIAIGGTIGTGLFISTGSLLHTTGPVMSLISFLFVTTLAYSVTQSLGEMTTYIPVSGLHQGSGGSAIVS

SEQ ID NO: 20084 - protein, 266 aa, Candida albicans
  UNSURE (45): Identity of amino acid sequences at the above locations are unknown.
MGSSNDSHQRLYNPYSSSISKSNEKTKHQTDFVQDSDIIEASSIXDEFGEVKRDLKARHVSMIAIGGTIGTGLFISTGSLLHTTGPVMSLISFLFVTTICFSVTQSLGEMATYIPISGSFAQFVTRWVSKSCGAANGWLYWFSWAVTFGLELSVVGQVIQFWTDAVPLAAWISIFFVILTIFNFFPVKFYGEVEFWIASIKIIAVFGWIIYAFIMVCGAGKTGPVGFRYWRNGYAWGDGILVNNNGKYVAAFVSGLINSIFTIQSA

SEQ ID NO: 20085 - protein, 197 aa, Candida albicans
RPVLIAMENSGTKVLPHIFNAVIVTTIISAGNSNIYSGSRILYGLAQAGVAPKFFLRTNKGGVPFFAVAFTAAFGALSYLACSSQGNKAFTWLLNITATAGLISWGFISVSHIRFMKTLQRRGISRDTLPFKAFFMPFSAYYGMVVCFIVVLIQGFTVFWDFNASDFFTAYISVILFIVLWVGFHFFFYGFGKDLLK

SEQ ID NO: 20086 - protein, 404 aa, Candida albicans
HNWGRVGTPRGGGISIFFVLLTTFNLFPVKYYGEVEFWIASTKVIAIVGWLIYAFCMVCGAGKTGPVGFRYWRNGYAWGDGMIVLNNGKYAISFINGLINAVFTFQGTELVAVTAGEASPRAIRSAIKKVMFRILVFYVLCMLFIGLLVPYNDPKLTQDGGFTRNSPFLIAMENSGTKVLPHIFNAVIVTTIISAGNSNVYSGSRILYGLAQAGVAPKFFLKTNKGGVPYFAVLFTAAFGALGYLACSEDGNKAFTWLLNIIATAGLIAWGFISVSHVRFMNVLRKRGLSRDILPYKAFFMPYSAYYAIIIIFIVVLIQGFTVFWDFNASDFFTAYISVILFVVLWIGFHFFFYGFGKDSFKWENILIPLDDCDIDSGVRDINDAEFDVPEPKNVWERFWLLIA

SEQ ID NO: 20087 - protein, 206 aa, Candida albicans
VAVTAGEASPRALRSAIRKVMFRILVFHVLCMLFMGLLVPYNDPKLTQDGGFTRNSPFHIAMENSGTKVLPHIFNAVIVTTIISAGNSNIYSGSRILYGLAQAGVVPKFFLRTNKGGVPFFAVAFTAAFGALGYLSCSSQGNKAFTWLLNITATAGLISWGFISVSHIRFMKTLKRRGISRDTVPFKAFFMPFSAYYGMFVRLVFT

SEQ ID NO: 20088 - protein, 407 aa, Candida albicans
  UNSURE (384): Identity of amino acid sequences at the above locations are unknown.
LDGTHKLIAETEGIELVSDGEETDISFWNLATMWLSANLVIATFSLGALGITVFGLAFGQAVLVIIFFSILGGFPVAFFSCFGSALGLRQMLLSKFLIGDLTTRLFAAINVVACVGWGAVNTMSSAQLLHIVNNGTLPPWAGCLIIVVCTVLVTFFGYHVIHAYEKWAWIPNLIIFIIIIVRFAMTNKFTSKSFEGGETTAGNVLSFGGTVFGFATGWTTYLSDYVVYHPRNTNSWKIFFSIFFGLLTPLMFTLILGAACATGIAGDPEWTRLYKEDSVGGLVYAILVHDSLHGFGQFCCVVLALSTVANNVPNMYSMALSAQTVWAGFRKIPRVAWTIAGNGATLAICIPAYYKSEAVMENFMNLISYYLSIYESIMCASHFXWNSGRFDGYDYERWNDKETTLLV

SEQ ID NO: 20089 - protein, 147 aa, Candida albicans
NNTGYMTSSHLTGLENFSSPHVPGSGAGAGLGVGARRDLTHNSNSLNNSNGGGGGSGGGPASANNSNNTNKRNTIYTDSETGTGITFRYKAKALYSYDANPDDINEISFVKDEILEVDDIDGKWWQARRANGQVGICPSNYVKLLDT

SEQ ID NO: 20090 - protein, 385 aa, Candida albicans
INYLEPNLRSKHTHIHTFTHLHNMGFSLSNFTSDPFAISTVSFGIMAWVVAIAGAASSKQENFPHFSWWGISYQIVIILIIFVLYANNNIELYKFTLVGLVSIAFIYTTNSTNNLIYNSNSAGNLCCAAGCILLSILNLIWILYFGGHPESPTNQFIDSFSLRGQGHEQLGSGSHNHNANNANNNIPIGAGNAIIGKGEMSPYNDRFAASGVNQPTSESLRLASGPQMGNGPFTTTGAIINPNLQQPLSDSIGGSAHHTPINVNNNNNNNNNTGYMTSSHLTGLENFSSPHVPGSGTGAGLGVGAGRDLTHNSNGGGGSGGGPASANNSNNTNKRNTIYTDSETGTGITFRYKAKALYSYDANPDDINDISFVLHQGVEIRVYLG

SEQ ID NO: 20091 - protein, 191 aa, Candida albicans
  UNSURE (178): Identity of amino acid sequences at the above locations are unknown.
HNRFSRAISTNRSEEESSSSLSSDSVGYVINSIWMDLPTILFSISINIMTILLIGKLIIAIRTRRYLGLKQFDSFHILLIGFSQTLIIPSIILVVHYFYLSQNKDSLLQQISLLLIILMLPLSSLWAQTANNTHNINSSPSLSFISRHHLSDSSRSGGSNTIVSNGGSNGGGRGGGNXPNLCLTTGKRTAN

SEQ ID NO: 20092 - protein, 407 aa, Candida albicans
  UNSURE (55): Identity of amino acid sequences at the above locations are unknown.
YSIGAILCAAAPIPKELADGTFNNHRSRDVMYAGKIYFGGLVLGIEGGGVGVYIXESVPSNKRGSLVSLYQLSIALGEVLGYAIAAIFYEVHGGWRFMVGSSLVFSTIVLIGLFFLPESPRYLVFKGKFGEAFNVFARLRDLGDRHSKIEFVQMVQAAEAERELRLTQNKSKVWFELVTIPRNRRALVYGIVMITLGQLTGINAVMYYLSTLMGRIGFSTKNSVFMSLVGGGSLLIGTIPAILYMDKFGRRVWGYNLVGFFVGLVLVGVGYSIDIETNLAAAEGVYLTGLILYMGFFGSYACLTWVVPAESFSLGTRSQGMTICSALLYLWAFTVTYNFNRMKVAMTYTGLTIGFYGGIAFLGFFYQVLFMPETKGKTLEEIDEIFEKPSRQLIKENLSGLKRFWGR

SEQ ID NO: 20093 - protein, 624 aa, Candida albicans
LSTKHQSMPSTQIRNSKTRTSLNGKYSKQVQNKSNGPVVDSLQLENLLLRDEDIFQTTLNSEDYLESLAPIMKDAIKSNGLSELLVKLNEIVKSKDEELNQASMESMDEINTCINTIDNIHKEANELNKQFIQVSSSLNKSAYELMSKKKNYVKYKDVCERINETQVVLNECIQVLELMNKILELIRQTKYFLALKLIDEIINIHIQKVEDFSFAKKIVDSIPHLTKMVKDESFENLCKWLSINLERKLQDIASGLYNNLDELQNNWSKIKKENGPTFLPYKINSPVELALRDPELNYNVFEDVSLQINLNAVYDAVLVYQTLQELDTLSSAYHKEWMSKYSRVIYPITTASVSKKDVVFDNNELYEYLRKIAAFFVTDKQLNLITKFQLRSNTQADELWLSYMTKLKPVLIQLLKHHNFTNIRELGSFKTIVGEFLQIMDNHDYDISELYEVMMMIFKEYYAPLTIQTFRKQFVASIQSDRYRPLTVTDEADYTAIMQNVWYKDDASFAPAYVKSFPVTFPFSEDYVHYCIQVRRLLKDVLRFIGDYYNYEIGELTNTIVNNIIEVVLSDEKGYGIAYEIEEFITRNENNKEITAQTYTNLEYYLFSLYEIGKCLHHGWRSRS

SEQ ID NO: 20094 - protein, 225 aa, Candida albicans
RVLPCEKNDEPNFAIKDFALFWKNLYTSIFNNLPLQLRTLGFFRTYDFVSEYFLNVLKDANVYNRIFVANFDLDIQYLETSLRNLHGFKEDGDEANGNGGNVALEYTFTELRQCIDLLNLEDYEEFINDSSFRMRRFDRVKYEDGINLIKKMQDNESKQQTSVSAMSERGTIGGVIPNSSSTRSFVNMLSNLSTDDAGNTSSGSIESTSTTSKLAQFTTRFKQNK

SEQ ID NO: 20095 - protein, 450 aa, Candida albicans
SSSPGEDGVTLAELSSAYPNAAAQIYWAQKLAPPKYARACAYFTGILLAAGSTFTTASVNMTSATAVVGMYMLHHPEKTIERWQVFIVYEAITVLLVFFNIYEKPLPMISSTTLYTSLFSFVVITIVVLSMHDGDFQSPHFVFVEFNNGTGWSSSAIAFIVGLINPNWSFSCLDAATHIAEESLSPATDIPKAILGTVAIGFITSFTYSIAMFFSIKNLDEILSSNTGVPILDIYYQATNSKAAAVGLEFLILLTSLGCSIGCSTWASRIIYSFARDNGLPLSKVWAKVDSRTGNVVNAHLLSNFWVMVIGCIYLGSSTAYNSILISCVTFLLLSYLIPTVFLVFKRNKFRHGPFWLNGFGLVCNIGLIVWAIFAFVFYNFPNVMPVTGSNMNYSSGVFGVCLIFSVADWTLRGRHQYTSLEEREKVKDELALQVSNQITNIQSIVSNRH

SEQ ID NO: 20096 - protein, 585 aa, Candida albicans
SNLDLSLYFFFFFTFFSLFLILQQISLILITRSLYIPPLYQTQSKYLMTQSDLNQLDSVSPQLSSFATDPTDQEKKLTEFNDDNKSVTSKDEDTKMSRNFSTLQIVTIGFGLTNSWLGILSTLILSISSLGPLLVVYGILIVASVSVCIAVTLGEMALAMPSAGGQYVWARVLAPKKYSSFLAYITGSISWGGAIFTTASMNLAVAYQVLGFWNMTHPDHVNQKWEVFIIYNILNWILFFFNIWHRFLPMIGDSVFGISLTSYCIILITVLVCARGHYQDAKFVFVHAVNNTGWPSKGIAFIVGLVNPAWAFSCLDSVTHLSEETAHPERDVPRAVLSTVGIGFVTSFTFSIAMFFCIRNLEEIMNSATGFPMLDIFYQALGSTKVGAICLGSLITLVATGCTLSCIIYQLRLLFSFLRDNGMPLSKYLSIIDPKTGGPFYAHLFSTVIVSVVSVLVFSDAALQATALACVSFLLIAYLIPTICLLARRRQIRHGPFWLGKIGVFCNFVLLAWCIFAVVFFSFPANYPVTAEGMNYFCVVLVVYIICMLGYWWFPIKKYACKYNFRGGNLNQEEVEFPDVCLTKW

SEQ ID NO: 20097 - protein, 381 aa, Candida albicans
  UNSURE (375): Identity of amino acid sequences at the above locations are unknown.
LTRKSWMNEAQKIFFIDCVGNSSLTLDTQQIGLVKVQKGKTGFMLSRKIVFPQAQLEKNLKLIKYMGFSFNLICSALAISTFVSTWIEVGGSPVVIFGFIVAITLDLIICYSLAELASAYPHSSAQVHWTYCLASEKYKRSLSFLTGILSCAGWIFACSSSTYVASMFILALAQIYHQEYIPKSFHYYLVYLAVFLSGYLVNVFLVKLLPLITNISVAVINFGTFFIIITLLVKSPKQSAEFVFKNIINETGWSSNGVVFFLGMLPSLACVTLFDGAVHLTDEIAQPERNIPLVMVISNTLSGVMAFFAAIVYMFCVVNVNNLSNPVGGEPIVQLMYDSFQSEALTTIGVVCLILTFVGSSYMYYTSTSRLIWSXANSNGL

SEQ ID NO: 20098 - protein, 565 aa, Candida albicans
LQSNPGAGDEEEEEENDSSFKAVPEELLQTDPRVGLTDDEVTKRRKRYGLNQMAEEQENLVLKFVMFFVGPIQFVMEAAAVLAAGLEDWVDFGVICALLLLNAFVGFIQEYQAGSIVDELKKTLANSALVVRNGQLVEIPANEVVPGDILQLEDGTVIPTDGRIVSEDCLLQVDQSAITGESLAVDKRSGDSCYSSSTVKTGEAFMIVTATGDSTFVGRAAALVNKASAGTGHFTEVLNGIGTTLLVFVIVTLLVVWVACFYRTVRIVPILRYTLAITIIGVPVGLPAVVTTTMAVGAAYLAKKQAIVQKLSAIESLAGVEILCSDKTGTLTKNKLSLHEPYTVEGVEPDDLMLTACLAASRKKKGLDAIDKAFLKSLINYPRAKAALPKYKVIEFQPFDPVSKKVTAIVESPEGERIICVKGAPLFVLKTVEDDHPIPEDVHENYQNTVAEFASRGFRSLGVARKRGEGHWEILGIMPCMDPPRDDTAATVNEARRLGLRVKMLTGDAVGIAKETCRQLGLGTNIYDADRLGLSGGGDMAGSEIADFVENGHHQPDGGIRTCVS

SEQ ID NO: 20099 - protein, 361 aa, Candida albicans
FPQKKFGAFKNYAQERANMKPQLGPVGGNPYANINPGTNNNNNNPYANDNGNNSNGNPNNNSNSNNGGNPYGGGATNNNPYGGSGGNGRGSSPSPYASTTSTTTRSSNPYGNNNGSRSSQNTSSPYAKSTNNSSYSNSPYSGSTVNNGNRGGHSNNSNSSAGGNPYATGGRSSQSQNSRDNVYTVPATRTSTRQTQGYGGGDTDSTLDLNAIPSHQMFDNKKPIKRNQQSSQQPANDYNLDLNDEYGEEEDLNLDISEVPEEQQQINSEDEEVEAIKQDIKFVKQESVQSTRNTLRMAQEADASGTNTLGMLGSQLERLYNAEQNLLLAETQTQIADEKVKELKRLNRSIFIFSPRAWKDR

SEQ ID NO: 20100 - protein, 63 aa, Candida albicans
ELGKRIALNLNQINHYAKKLKGLANTMGTEVDNLNTRLKKIEESADKLDINVHMNTTRLNNIR

SEQ ID NO: 20101 - protein, 800 aa, Candida albicans
FKGIHYIMDPPYPLLSKLEEDVKTNLILHPQISSFIQLFLRYLKEPRYQAPLTITELSTLFKKFYQDLNVLTICIFTQSNSTKKQLISHCDYFNENPKVCDYLLAIANYSTSSIRLLKRSDNDALYQLRVFNYYKLLTIFESIHLAELELFQSVSLGDDICLYDKIFRFDQKDTIYQEFLQEKLNCLRQLNLSFKHFIDQDLGNQDKLVNIIDNLTQEDLILLQEDLTSLNTEITPYAKLKKIVSLHKNLIKLFSQKGFENKEINNDLLLPALIYLLVYKLETNDLYLSFLFIRNFLNLIDSLPIELYQINLYLSYNPAQERTPLSSSKYKKSDILGYLNLQDSQDLPQEQSHILSDEFKFFTNDKELISYINQKFLNTGELNYYLTNFEAMIVYLSNMTIAELLSNSETEISSDLRNSSILKHPIDKLVDEELLTHFQFPDGELANEMKATENKVREDEAGRSRSSSLLNTISNKINETRSRSSSLRKEKFPSLPTPTEELEENSGFAMMRNILGRFSSASGATEGVYDEENNDSPQSNLKKTNSFISKVSPIHSRTRSSSLENATATPGHYKRNSITAKFTSGVSEFMTKLNQPAIPSNLHPDNSVSNVSLQSIEDGDSDATMSRRPTAGRNRTTSIQILDKWFGNLSPSQTNSQPLTVQQQEAIPASTIPSVQPPIPPKAKPEVLSEELIVDIEQLTKFHNSDFESLSIQDLRELKNYYDQLCQDLLSNGNHESNGKIYVNSRTNSIDKVGSHANSLDKFIGKEAPEAGDLNSKAESVESSDRFGTATIITSSNNSL

SEQ ID NO: 20102 - protein, 222 aa, Candida albicans
QLYFVEKKKTYKSNIKSQSLNLFSLLFHFLLVSPFLLRRLITFINYTHTNTLHNFKMGFTDLYKPLESPEKRSDTNTDNLSEYSTDHEIEAGVQLDQNVKQIGIISATFLIINRCIGAGIFATGSTIYTLSGSVGTSLILWVAGTLIAFAGLLVYMEFGSVLTRNGSEVVYLQHIYKSPRFLVISSYAVYALTMPWTAGNSVVTGEYILTAVGKELTSSPTG

SEQ ID NO: 20103 - protein, 283 aa, Candida albicans
VYIFPMSYPTPKKEQDSILSESYQSFSTASTKNPIKNFIYSFRVNKDLQVTSDEITTPDDLLKGYQVKLIALSSCIGSGLFISSASMISSAGPGGTVIGYFIVAILMFFIVQALGELTSSYPVRGNFLVYNTRFIDESWGFAMNWNYCLQWIVNIPLSLVAASLTIQYWTDKIDPAVWVAIFWVVIVGISIFGVKGYGYGESLFSVIKVVAIAGFCILGVILAAGGGEQGYIGGRNWHPPFVNGFHGICNTLVNLAFSYSGTELAAIAAAETSNPRKSLNKII

SEQ ID NO: 20104 - protein, 210 aa, Candida albicans
PRGRRPNLQRKLKTRHLQMIAIGSSIGTGLFVGTGGALSTGGPAAIVLAWAISAISVFMTMQGLGELAVAFPVSGGFNLYASKFLEPGIGFAVGWNYFLQFFVLLPLELVAGAITIKYWNASINSDVFVIIFWFVVLVITMLGVRWYGEAELVFCTIKVIAVIGFIILGIVSICGGGPNHEFIGGKYWRETGPFANSFKGFASSLITAAF

SEQ ID NO: 20105 - protein, 362 aa, Candida albicans
  UNSURE (329),(330): Identity of amino acid sequences at the above locations are unknown.
LLVLPAKAVLTKALLDKSFKLNAEARHKYPLGKITSMLGTDLSRIDFALGFQPFLIVFPVPIGIAIAILIIHIGPASLVGVGILFVFMIAIAFSTGKLFAYRKKANFYTDSRVNYIKEALTNLKVIKFYSWEPPYHENISNVRKKEMKIIYRMQVLRNVVTSFAMSLTLFASMTAFLVLYAIRTHNRDPASIFSSLSLYNTLTQQVFLLPMALASGADAFMGISRVGEFMSQGEIREGENSIEATPEMKQLMEQDDLAIEVDHADFEWETFADEEDPDKKKDVDGDGDGDDEDKNTADVITSTHEVTSEKSYAKENGSSTIASNSEEKXXEKAQSKDLEEKITFKGLKDINIKVKKGEFMVI

SEQ ID NO: 20106 - protein, 154 aa, Candida albicans
IVHIMTPPPNSDALENQELLQRQKRLLSFMLSKKVPPVPTQDERKPYPASSANIFSRMFFWWLSPVMKSGYKRTLQPDDLFYLTDDIKVQHMADAFYGYMSNDIAKARQQHILEKCKERGETLVNSSVDPETDLQDFKLSKFLTVWALAKTFKW

SEQ ID NO: 20107 - protein, 240 aa, Candida albicans
NWGKIIIDDIDISTLGLKDLRSKLSIIPQDPVLFRGSIRKNLDPFNEHSDDKLWDALRRTGLIEESRLDIVKKQIKPTIEHKNQDTKKKNKKDNKKDNGNGDSGSGDVSSTLHKFHLDQTVEEEGSNFSLGERQLIAFARALVRDSRILILDEATSSVDYETDSKIQHTIIKEFKDCTILCIAHRLKTIINYDRILVLDKGEIKEFDTPWNLFNTENSIFQQMCHRSNITEQDFQEATGF

SEQ ID NO: 20108 - protein, 164 aa, Candida albicans
RVGKHIMNNCILDLLKDKTRILATHQLSLIGSADRVIFLNPNGTIDVGKFEELQATNESFSKLMAYNSESKKENDEDEDKDNDEPQDGIELEEDPMEDELEEERKMIQRQITQRTQPEDKEVEDEEGRHREFNVDNTADGTLIEAEDRAVNATSLHHGDGTNRP

SEQ ID NO: 20109 - protein, 171 aa, Candida albicans
  UNSURE (162),(171): Identity of amino acid sequences at the above locations are unknown.
APMSFMDTTPMGRILNRFTKDTDVLDNEIGDQLRFFLFVLANIIGVLILCIIYLPWFAIAIPFLGFLFVSIANYYQASAREIKRLEAIQRSLVYNNFDETLSGMITIKAYHATERFALKNNYLIDRMNEAYYITIANQRWLAIHMDFVAALFALLIALLALXSPRTCTIQX

SEQ ID NO: 20110 - protein, 128 aa, Candida albicans
IMKIADKRDDGDTTIYMTLTSTSTLGSKSSPNASPTNVIQIVSWVAQTIETTIVTSTPVLKVPSTSQVNTVTSKSITTVSNTAETKKVIGSSSAEATISPSQSDFLSPTASTELGAVCYRTRPLANHS

SEQ ID NO: 20111 - protein, 580 aa, Candida albicans
  UNSURE (19): Identity of amino acid sequences at the above locations are unknown.
IIFELLNLMHVEEQEFLTXNKNIRRDKEAPKSKNQSLVRRKRRKNNKKQPNSERDILSPTIIQSVETEKQFQLFMCLTTYIDRLSLWDTLSVKSGGDGMYGFIGYVLVPYFHKKLPKLVEFVVESMESLYMKLVSLKRKKSDQVDTEEHEQVDTEIEHGTTPQESDTPKHQDETLKMKPRSKYRKVLLDKNPPKLSKSTSIVDSDDFKPLISLKKSKSNLSAKHLSKREVDLNLKQSSKADFSSISTASLSFIFGTRAKKSLSASTVTTSRPTRTKSEKIATTPVKPKLKHSVSQIEATPAKARKVYMQPQVQATPVAPQQQPLLLLLQQQQQQRHSISISPSHKENNASTLSESAYLLEVEATPLKSNSLVITTPTDQFIKPDNKHRQSINEKLSSLSKYLTVEMTPKQNNLIFSTPRNIRITTEPGMVSNSDNKGTGNETNNMFNTPLHHQQLIGSSPLKSRRESVSSVTSIISNTNNNHNHFENRYGKSGPKPGDPVALESSPFISILSDSENLMGLRPKKLFDSITTSPQDKNYDDEKVVKNSHNNNEYDSEYDSDELLNPSSKQTVRSTYSNRRK

SEQ ID NO: 20112 - protein, 490 aa, Candida albicans
TYQTQQCQHYIPHLLVKLLYISSTHALSLSRCSSTNLGGEKTSSEFMSNGLCRDTCSKDGYAVAVLSGNDCYCTNDVPADTTDMSNCEIGCPGYKDQENCAGDGYFGYLIIGQPSATVGGETSTSKSTQSSTSTSTSTSSTSTSSTTSSSSSTSTTSSSSSTSTSTTSETSSSISPATTMVTKTTQITETHRSSNIVQVTQYSTEVLTVFPSTTSKSFTSSSSKSSSQTPIVSTKIEQTTAYSIKTVNGTQTQEIKTLYITQFTTQSTLDSTTGTTSFESASISNLRSQDASVAPTLSVPSSSTTDSPKTNKNAFFDDKGKVAGTFTAVGIVVVGIVGAMLYCCCCFGGAGGRHNDHDGYSDEENQYSSDELSVNHATVVAPYSKQSSFSTLKRDSSSKTLFAYFTGDNTNKESGVNRSSSRRKLMSRRSSQMSSSPNNNPEADGGAMFPINEIDSRLDPDTMFLNQNFSNKSLGDNQDYSRKLKITNPE

SEQ ID NO: 20113 - protein, 113 aa, Candida albicans
LTRGSCQPRGEDMLAVMFLNQFHLILVHYLCNSKLNIGNKSAPKSLDRDTIIDNITLILELLDECLDYGLLQITDYKLLEEYIKVLPNIPKIDGLTDKYDTSDSDDSIDEYEP

SEQ ID NO: 20114 - protein, 237 aa, Candida albicans
KETKKSKSKTKIGKNNNGSKKEIKSTRNQAIKTDVIENEQTNMINSSILRTYSLAINWRPKGIFYAKNEIFIDIIEDCEFVYDLGTGVIKCNEIYGTCVVKSYLSGMPVCRLGFNERNLSRIEDDQEEESLGIPENQLNLLKEDQNEDDDEEEGEGDQETNGEETEILEHIPEFPASEALTDKKQKHKIPIRNIQFHQCIELSKIYKENIVTFIPPDDKFVWMTYNVEQQKQKKKLH

SEQ ID NO: 20115 - protein, 219 aa, Candida albicans
TRISTEEDTVKDLIIRIPIKPHYFDLDANDDDLKYKAELGEVSFKIDSFELIWKIDSIDGKKMVRMMTELALVNTEEVSEQRILDYLSRRATASSVVGTDEQNSTDTAEDTREELDKFYGVNGKTTSLTQKMSLKFKSSVFNDDIKVHFKLPMVTYSGLKLSYLSVEEEQMKYPCFPWVRYLTKSIDHYEPSIALENQKFSGRCCDYRFKLSLNCFVVA

SEQ ID NO: 20116 - protein, 275 aa, Candida albicans
  UNSURE (237),(272): Identity of amino acid sequences at the above locations are unknown.
RYINPRAQNKSMINVSHITCVVFGLGIAGFSVMLHYVGVHMTWFGYFTPMMICPGILPLIFTVTWNRQTYWAAFISPLVGFVVGLAVWVSTAYHFYGEVTIKSTGGQLPALYGSLTSMMLPGVLSIIISLVKPEKFDWDKLKTADLLIGEEEEEGSSPNIQPKNEESDLNKEKQAGVEVNFESVETSSLEQQQQKLSSQLTNKELEFWIKIATGAAIFVLLITWVIWPMSVYPDWIXTGTYFKRYVTVGLIWWYSTLIVIGSVPFYTGMHSXSTV

SEQ ID NO: 20117 - protein, 273 aa, Candida albicans
MAQLSSQGNNAIIYLSYAFMLATGLFLAWKFSSNKDFLSSNGTQRGIPLALNFVASAMGVGIITTYAQIANIAGLHGLLVYTICGAIPIVGFAVVGPVIRRKCPDGFILTEWVRHRFGMVTALYLSAFTCLTMFLFMVGELSAIRSAIETLTGLNALGAVIVECVVTTIYTFFGGFRVSFITDNFQGVCVLLLLIICAAGMGSYIEIDTSKIGPSGLLKANKLGWQLVYILFVAIVTNDCFMSGFWLRTFASKTDKDLWIGTSSVHHGLEGPH

SEQ ID NO: 20118 - protein, 345 aa, Candida albicans
FFEVSLRFMAENIVHLLTQGAGYGVLVGVGAVFAGGMILTTFLYQKYLHENAYSTETFSVANRSVVTFLSASAVYSSWSWATEFLLVTLMTYNYGIQAGFYFGAGLAVQIAVMSVLGIHAKKKIPTAHTSLEAVQLRYGKAAHLLYLLLSLICNICSCLSMILACAANISIIAGNLHIVASTMLIPFGVLLYTVVGGLKATFLTDFIHTTILLIVLCYINTAVLTSEQVGGLNGLYDKIVEVSTTKYIEGNYDGAILTGKSQGSVMFGLILTICNFGLTVMDSSFWQKTFSASPRATVPAYLLTAFLIFSNVWPIGAIIGGALHFLENDPSFPPYLHLGTNKSPL

SEQ ID NO: 20119 - protein, 384 aa, Candida albicans
ERFQMSESAVHLLDQAAGYGVLVGVGALFAGGMILTTFLLQRYLHENANSTETFAVANRSVGTFLSASAVYSSWSWSTEFLLVSLMTYNYGIQAGYYYGAGLAIQIAVMSVIGIHAKKKIPTAHTSLEAIELRYGKSAHLLYLTLSLICNICSCLAMILACASGISIIAGNLHIVASTLLIPFGVLLYTVVGGLKATFLTDFVHSSILLIILCYLNTSVLTSEQVGGLNGLYDKLLKVSATKHIEGNYDGSILTGKSQGAAIFGLILTAGNFGLSIMDSSFWQKTFSARPRSTVPSYLITAFLICSNVWPLSAIIGGSLHFLETDPSFPTYPRKMNQYEVDSGFVLPYVLKATIGNGGVGALLLIFYLAVTSTVSAQMVSLSSP

SEQ ID NO: 20120 - protein, 503 aa, Candida albicans
QAVWEIVTKLAESNPREGNAGGSYFTMHSRSGGMFFVINIIGNFGTVFLDNGYFNKAFAANPLSTYKGYIFGSLAWCAIPALCSLTMGFAALALEHTEYWPLGRPMTAAEVASGLVLPNAASALLGKAGAVLALLMVFMAVTSAMSAELIAVSTIATYDIYRTYINPNASGKKLIWVSHLSTVIFAYTMAGFAIGLYYAKVSMGYLYEMMGVIIGGAVLSSALTILSKRQNWHAATFSPIISTALAIMAWLVCTKKKFGSVTYLKTFEDDAMLTGNCVALLTPFIIVPILTFIFKPQNFDWKLLDQRITRVDEEEELAEALGGTVSSDPERLHPIKSQISVIASQLVEGEREQYQKEKEILNKSFKICCIVCCTLAICLVVLFPMPLYGTKYIFSKKFFTGWVVVFIIWLFYSAFQVIIFPIWESRTDLYHTFRGIYWDLTGQTYKLKAWRNEHPEEMHAVRSQLQAQLSRTAVTHEIVDGKAFGDGYVTPANIDDALEEKKG

SEQ ID NO: 20121 - protein, 681 aa, Candida albicans
  UNSURE (647),(670): Identity of amino acid sequences at the above locations are unknown.
ITMSESSVHLLNQAAGYGVLIGVGALFAGGMILTTFLLQKYLHENANSTETFSVANRSVGTFLSASAVYSSWSWSTEFLFVSLMTYNYGVQAGYYYGAGLAIQIAVMSVIGIHAKKRIPTAHTSLEAVQLRYGKAAHLLYLVLSLICNICSCLAMILACASGISIIAGNLHIVASTMLIPSGVLLYTVVGGLKATFLTDFVHTTVLLVVLCYIHTAVLTSDQVGGIDGLYDKIIEVSKTKFIEGNYDGSILTGKSKGSVIFGLVLTAGNFGLTVMDSSFWQKTFSASPRATVPAYLLTAFLIFSNVWPISAIIGGSLHFLESDPSFPTYPRKMTQYEIDSGFVLPYVLKAILGNGGVGALLLILYLAVTSTVSAQMVSVSSIVSFDIYKKYIHPNAQNKSMINVSHITCVVFGLGIAGFSIMLHYVGVNMTWFGYFIPMAICPGVIPLIFTVTRDRQTFWAAFISPIVGFAAGLAVWISTAYHFYGSVTIESTGGQLPALYGSLTALLLPGTLSIIISFIKPEKFDWEKLKQVNLLVDGDSSSEVEIDNDTPTIPKEKQDGVEVNFESDETSSLEQQQQSQAASQLTVKEMDFWIKISTGSVIFILLVTWVIWPMSVYRDWVFTASYFKGYVTVALIWLYTTLIVIXLVPFYTGRHSAAKVLKSVYNDYXKRKLCFILLTN

SEQ ID NO: 20122 - protein, 203 aa, Candida albicans
  UNSURE (191): Identity of amino acid sequences at the above locations are unknown.
SKMVDLYVPLPQSAGYAVVVGLGFVFAFGMMLTTYILRRYNKEVMTAEEFATAGRSVKTGLIAACIVLSWTWSVTLNGSTSQVYNNGVCGLIFYAMGATVQITLFACLAIKARERAPAAHTYLEIVKGRYGTTTHFVYIFWGIVTNILVTSMLLSGGSATVNDLTEMNIVAAILLLPLGVVIYTLLCWYQXYMSTPGESQSLR

SEQ ID NO: 20123 - protein, 401 aa, Candida albicans
  UNSURE (23): Identity of amino acid sequences at the above locations are unknown.
KVSKDGFQAGFKKGQTPYLGTIXVFFFTKYNNRGLFYNRGGLVYKGGVIYWVVGVCYSLPHNLFVYSHKVDEFVSGSRRVGFGLLLAGILLSWTWSLTLLESAVKSYSMGFCGSYYYAIGGLLQVSIFSVISSKIKKNANLVTTFPEMGYFRFGVPGHLAFLWCGFVCNAIVSSCILLGGSAVLHAVTGVSQYASLFLIPFGVAVYVSFGGLSATFISDASHTFIILIFIIVFMFEVYVSNDKIGSAQKMWELLESLPPVENNYQGSYLTFRSEQGAIFAVISVITGIGLVVADQAYLQRAVAADPRITSRAYFFAALCWFVIPFAMGASLGLGARALSVYPDFPKLTDFEVGEGLPAAAAATYLMGKTGLAMIIVMIFFSVTSSYAGELIATSTLVSYDL

SEQ ID NO: 20124 - protein, 179 aa, Candida albicans
RGSSTSWCRMALVMGGVISIVLSLIWPANFDFDNTRNKTSLAEQNTELIKQQSSGTTKLDETKDQNVEIETEIANSDLDMDLNAEIDHKHLDQQFKKYTILVIVLAIIFVFIIPVPSGGSPYVFSPNFSLGCVIIITIWLYFSLFYVVILPLFEARKTLWQITKHISRIDSKSESNQYK

SEQ ID NO: 20125 - protein, 142 aa, Candida albicans
HHNHLGPCAWVIVAEVFPLGMRAKGVSLGSSFNWLMNFSVAISTPKFVANAKYGAYIFLGLMCVIGLMYVYFMVPETKNKTLDELDEVFGDFTGTSKKESELREKILKQVGLVDLLVGSDKELDSFRSKPEVEYKEKEAHSE

SEQ ID NO: 20126 - protein, 138 aa, Candida albicans
CHDLYDFTLCVFFASTWAGGVYSIISELYPLKVRSKVMGLANASNWTWGFLISFFTSFITDAIHFYYGFVFMGCLVFSIFFVYFMVYETKGLTLEEIDELYSTKVLPWKSAGWVPPSEEEMATSTGYAGDAKPEEEHV

SEQ ID NO: 20127 - protein, 374 aa, Candida albicans
NPSNILLVYRFVFSFFYHFLQTPFITVIIKIFTMLKGDLEELDIQKLIVEKRLEQSNGSGFATMKRNKRALGTCLFVSLGGILYGYNQGMFGQVSSMHSFGETVGIGKIQDNPTLQGLLTSILELGAWVGVLMNGYVADALGRRASVVIGCILFNIGVIIQAVARDADYGYILGGRFVIGLGVGVLSMVVPLYNSEISRAEIRGANTAIYQLSITFGIMISYWITYGTNFIGGTGDNQSQASWLVPMCIQAAPAIILAVFIYSFPESPRWLINVGQEDKALEVLAWLRETEQENVGLQIEFLEMKAQKIFEQTLETEAYPHLQDGTKMSKFKINLNQYKSMVTHLPTFKRVSVACLTMVFQQWTGAYVSNTFFF

SEQ ID NO: 20128 - protein, 75 aa, Candida albicans
GQRSEPGGGPSVWSSAGSSKTMLTPCSMLRLEEVYDVTVVKDGQEAYDTVKANMEEGKVFDVIFMDIQVYATVTM

SEQ ID NO: 20129 - protein, 349 aa, Candida albicans
ETYKSNSDGVISYQVENLPSWLSFDSSSRTFTGKPQESDVGLFEITLIGTDSTDQSQLSNNYTMMVSNDTGLYLTSQALLYSELSKSGQTNGNGGLVVKPGDKIKIQFEKNLFKSYSSSDRPIIAYYGRSADRSSLPNWIYFDGDTLTFSGTVPYVTSENAPSIDYSFSFIASDYYGFAGAEGKFKIVVGGHQLSTSMNETNIVNGTIGSKIDESIPILSDVFLDGQPISKENISDIYDQDLPNYATFDKNNFTITGTFPNTSTTDNFTIVVKDIYGNSVELPYSFDVVNSIFTIDSLKDVNATRGQYFQYQILKSYFTDAEDTKVTVDFGSGTNSDWLQYHDSNIFTT

SEQ ID NO: 20130 - protein, 76 aa, Candida albicans
  UNSURE (60),(68),(70): Identity of amino acid sequences at the above locations are unknown.
SLHAQSYLFTSTTLSDSTTTLHIGMKFAESLKEGLVPEWQDQYVDYKEGIKLIGTCPKLXRRCRPGPXRXLKLPRC

SEQ ID NO: 20131 - protein, 352 aa, Candida albicans
FFSYRGNILYGNSRRWLQVALWRLLLSGLYPVEFRDFFLGDIVSSLTYTMGNISFFFCLYSHHWKGTLPGQIPSQNTCGSDKSRLMGFFSTLPSIWRFLQCIRRYMDTGDWFPHLANLMKYTITAIYYITLSIYRIDRKTQNRAVFIVFASMNSIISSIWDIVMDWSLLQSDSKNFLLRDHLFYKNPNYYYAAMITDVILRFQWVFYAFFTRQIQQSAVTSFCIAVAEIVRRFIWILFRMENEHATNVILFRASKDTPLPYSVSNKVEKAIKKLVELRYYSKFSEQQEPNFQDYSMDFQSTSPSNVGVNASTTIDTSATTGYSAARDKDTHIHESSIPIHRKTIASNRIITS

SEQ ID NO: 20132 - protein, 574 aa, Candida albicans
LTRKMNKPKSFWKKLVVSMEVQPKGDLSTAQMFLYNHDLRPVEEARREWAWYNYVFFWIADSFNINTWQIAATGIQAGGMNWWQTWISVWLGYALCGIFVSIGARVGTLYHISFPVAARSSFGIYGSLWPVLNRVFMSCIWYSVQTAIAGPTFELMLHSIFGKNLPQRIHDTIPDKDLTTFQFLGIFLFWLFQLPFLWFPPHKIRHLFTVKAYVAPIAGIAFLVWTIVKAGGIGPVVHQKSKVHGSELAWVFVESTMNSLGNFATLIVNAPDFSRFASQPSFGMKYLVYTLSIPICFSITSLIGILVTSASEAMYGKPFWSPLDVLGTFLNDYTPGNRAGVFFISAAFALAQLGTNISANSLSFGTDCSALLPRFLNIRRGGYICAFLALAICPWKLISTSSKFTTYLSAYSVFLSSVAGVVACDYFYVRRGFILLIDLYSLTNPDNKHQDSIYRYNKIGVNWRAYVAYICGILPNIVGFVGATETHKVPIGATQVYRLNFFMGFFTAWIIYSVLCYFFPVPTGTVKVGPFEKGWFEEWQDVETFDEELVGHEVHDGIEKIEYLEESVSSKKKI

SEQ ID NO: 20133 - protein, 210 aa, Candida albicans
LLSTGIFGILKAFAALVWMFCIVDRLGRRTALIYFSFPCSICMWYIGAYIKIAKPGLRVANGDTHQDAGGKAAQAMLYIWTIFYGSSWNGTPWVINSEIFSQEVRTLTQAINSMSNWFWAFIMGRFSGEAVKAIGYKFYFIFATCMAVFPIVIFFLYPETKGVPLEAVDYLFEVPAWRARPYAMAKYQKEYQKQNLSTSIPEEQLEKRLD

SEQ ID NO: 20134 - protein, 308 aa, Candida albicans
ESFHEMRVLTRKVKSRHKNVSLALTIAVFMIFWLIGALIFQKIEKWSYFDAMYFCLLCLITIGYGDYAPKTSLGRVFFVSWAVGAVPLMTILVSNVGDTLYEISNDISAWFSTWMFSTKEEYRDLKWKKKKLQEDQEDQLTVNSEAVRSSELDEDLDLAKMEQEASLEARDNSSNGEIGAASIDNPNEDVKVEDNDTCITNSSNSNMRKDQENNSYSERSVCKSEKQNFDIERIRQKIASKKQVHEMLIDYLEKMKPLIGDSIESPNRKYSYKQWKGAYDGFWLSESSPLRLPLKEPNYLILKIYFGD

SEQ ID NO: 20135 - protein, 428 aa, Candida albicans
IYIDSPGKNVVKEKKRNLFIPDHTPHAPLFSDYQNLDNRLSLKMGFHAPLNGSSKNSKSSAFASFDSASVMQIVNKAKDKIVPDAQFHQTITDQGIRHYQEKLSPLLQNSYHGANVNTNKQDSSPMKSPVTLQHALNVRLESILSLNVRPGEPFFVLWFLISSYFPLIAACLGPLANMISIVALVEHWKVDIITRKNVPDIPKVVVMNAVSLALGLIGNISLLMNFSRSVKYLVSQSVSIIAWLCASALLAAALFVTNREFGGENPKYVPSEGFYFAAFTSGNYFVCMLILVINFMGYSLKKYPPTFNLDQRQRTLMLFTILFSTWTVIGAFTMGSLIDDISYGSALYYCIVSFLTIGLGDILPETSGAKVAVLVFSLGGVLIMGLIVATLRLVILSSAAPAIFWNDVEKTRIALLSQLDKENRHLTL

SEQ ID NO: 20136 - protein, 480 aa, Candida albicans
TCSAVAGESCIVRMSGLDRGANTATTTTTSSSSTTSSSSYSITYSTNEIPILTYSNNNNNNSLHIHQSSEVHETSHHSQYEENTFIDWSKESIIISRNPSVFLTNKWIILIFSAIILGYFTSAIDLIQVSLNDFKKGICFSSKDSWTLLNPYMTCPVEDWYNWDQIFFTIRNPIVKFIINFPIYLILALAFGIIAGYLTYNRAYMIRQSGIPEIKLIISGFNLKIDQYLGFKTLLLKSIALIFVVSSGLWLGKEGPLVHISCCVLNIIYEIISKYYSNQNEAIRRELLTAATATGISVAFNSLIGGVLFVLESMPSYFIPTRIMWNSFVSATVATIILTGFKIFTDGRNFNEQVLFQVNFGNFSWLFVEIIPFIMLGIMGGVYGHYFIKFNGKFSNIKIRSLIRHRLCNLLKVDYKYGSILEILLIVLITTIINFPFEISKLPLNALLNLLFKSCTKDNDNSNLSTSKDFICQDSNGVAL

SEQ ID NO: 20137 - protein, 154 aa, Candida albicans
AAKLVKFYAPSAAGSGISEIKCIVSGFVMDGFLGWPTLFIKSLGLPLAIGSGLSVGKEGPSVHYAVCVGNSIAKLITKYRKSALRAREFLTATAAAGVAVAFGSPMGGVLFSVEEISTVFQLNTIWKSYFCALIAVTTLAALNPFRTGQMFFFE

SEQ ID NO: 20138 - protein, 415 aa, Candida albicans
ISHTSCCIQEKVFGQFCSQRSFDMDFVYSKFLYFNQFLRLDMTETMQILFHECDKNFHHPICDSLNKKTGIIVSLLFATLARMLLTIVTYGCIVPAGIFVHSMAAGATFGRALGIIVDLVYANHKDSFVFRNCPKDGKCIIPGTYAFLGAAAGLCGITDLTVTVVIIMFELTGALRYIIPTMIVVAITKSINDKWGKGGIADQMIKFNGLPLIDSKEVFTFGTTVESAMSTVIVSLSTDLNDSITLKQLRTTLQKTRYRGFPIIKSSKDPKIIGYVSRHDLECILKTHENVNEDILCNFNEAESGGVDKVDFDAVINKSPLTVNFNTSLEYVLDIFAKLGARYLLVEKEGCLVGIITRKDVLRYEYTVHEHNRDNVQQANHDAFDEKVWEFINLIGTSAKKNIGKILHNDANRYL

SEQ ID NO: 20139 - protein, 822 aa, Candida albicans
NSLSFLEKENSFVCSFFTCIHSTYFFFFIREKNNMSSDQSTSNHLNQNTKPGLQKPNLTFAPDIKHPPHSSFIKDQTKTIRTVPNSPYIDSCSTPPPPSSSNTLLSGSRPLTKVKSLGKIDIRSPIPINSVLQTPRIPALDQLQDETYSLRTTQTNESMRSRFFGKVHDTFISIRIFYNDFTTIDWTKAYLKGNQFNYSIEKKQWIGDDSVNDGQAIPFLHRAYYTLGKWFLILIIAFFFSIIAFCIDKVEILLVGFKHGYCRSNWFASQISCCIDNPKKLNVFKSGYVTNNTCDNWVSWNKFFHEHWLNTMRFDFIIYVVLTILLAMFACLITLSTKITGGSIPEDQSNHGKEIHADDNENATNQGRSVSVKPRVIYTATGSGVPEVKTILSGFVIRRFLGTYTLIAKTVALVFAIALGMSLGKEGPYVHLATCVGNITSRFFPFIYENDFFEKQILSASASAGVALAFGSPLGGVLFILEEINNYLPSNQLFQIFFCAIISTLFLKFLNPYGTGKTVLFELEYFSDWSPMELIFFVVIGIMGGVFGASFIKFSQWWAKKFRSNKHIKTHPIFEVFLVAAVTGIISFWNPYTKQASAELVLDLATPCSGGELDRSLCPQTEKQLLNELASLLFAFVVKVFLTFITFGLKLPCGIYVPSMVCGALFGRIFALFIRWLEFLSRKSSSSSSAFSTLSLPAPPLEFGLLCSSAGPHCVDMGIYAMISAGAFMAGVTRMNITLVTILFELTSSYTYVLPISIAIAVANWSGGLLEKNSLYESLLISNDYPFMAPETEPIDPYVSAGDIINQDSLPTTRYSPRLEIR

SEQ ID NO: 20140 - protein, 252 aa, Candida albicans
  UNSURE (191),(202),(227): Identity of amino acid sequences at the above locations are unknown.
TRFSFRGQEGAASFMTGVTKLTMSVVVIMFEMTGAVTYVLPIMGGVMTSKFVSDWLTPNNIYDTWLQNNFNQSSDGVEGVTTNNHLNSNFYDNGNQLINQGKGTGLISFQNLTSTIKSKLPNINIASSMIPLLDVKCLCLLPDQEQEQFTLNSLNSFINNDCHEGYPMIINYNNPIIVGYIPKSQLLNQLXLSLSNREIDSXSPISFQINHGVDIPERVEQLLSQRXQPQVVLINVHPIQSTLNNNEKTPNL

SEQ ID NO: 20141 - protein, 178 aa, Candida albicans
LQNLGATPFQGSFFLLLIYFLIFRPFFYAHNSPILLNNQQMTTYQPVEQSLVEEESDLTLFLDLVRSRSTGSWINQDNIREVQRFNDFRTIDWVEDELDAQKKRVLKARHITSRGNNMKDKIISQAQNWVVLGIMGCSIGLIAGSLNIITSFLSNIRTGHCKRNFILSSPRAANPRAN

SEQ ID NO: 20142 - protein, 330 aa, Candida albicans
VGQIWCLLRLVKKTNTIPSSTETSIKSATVTTPVSESTNTGMSIFMSTTTESKTTDITTETSVSGEVNLGSATVKVSSSEFISKGTVTRIMPTELTNSESTFTASPSFVLTSTESSVIETPATIEMSSRSSSYSVPLSKLRSEGETTRVIPTSSTATGSTVIGSPSSVSTSNESIITGSSSFVSTTAETISTRSIVTESIVAGSPSLVLTTTVLDTTETTITETSIVGELSSRSLTFKASSLSKGEITGTVTPEMSVSTSKATTGTTSEVSIKESLTTKVPTFTSTTIKPETSETQHSESRTTQIPYSETKGSQLSTANSQVSQTGSSKS

SEQ ID NO: 20143 - protein, 312 aa, Candida albicans
DSDNKCYLTTEVQSSTTYTTTIDGVLTVITTAVPISKTETSSPLVITSSAAAAVTEESTETEVLTTVITVTSCSDNKCALTVFTSGYSVYTIDETAYTTYFPVTTITSKLSSASINGEATNTKAAAATKATATASVATSVATSGTPQETETKISTAIVTITSCSNNKCHEQTKTTGIKVYTSEETVYTTYCPLSSTSEQKTTNSVETPKSNPSNPSSSPIVEKSSSLEATSSNTATTSTSTTTSIPPVTINVISGNIVTETPVVDQIQSTSTHNPQKSTIAISTYEGVGATIITSNVTGFLSLVISLIFFMI

SEQ ID NO: 20144 - protein, 133 aa, Candida albicans
  UNSURE (124): Identity of amino acid sequences at the above locations are unknown.
KLTTSMKFTHLFFIGLLTKVYTETVTVLSTRSYRLATTELTPTDGTVYLTLTRQQSLSTSLNASTITTPPLNLSASVQTTAVTDCHFHNSVQYCVDGYGNEGSILPVPTNTNNLPTSYDGPIPXVMIAPAPRV

SEQ ID NO: 20145 - protein, 829 aa, Candida albicans
NMMTLVAVSILPLIKILVGLNFEVVVKLVEKFFEDNSYYRTFISSVHVFDFLNGYNSINDRDWENDDDLLLVYMILCLSIERLSPQDFVELNLLPDGSLNVCTKYRKFLTRQVLYKSFERLKENLVDESMITIQAYILCSEWLFLQQNYEECWKMMFHACSISFSIGLHIMNQFRETNTKENKPFKNVVDATMGESDSSSEKKDTMELEEDKKNEDEELNAQQYRLWYALKYLTSVICSIFGRPNPISVKVGMIDSTPLNQIDQKLHVLLKSESSELLRLSNLMLIENYMIDISFENVMTLKLKFDTDILTLEDSYDSIHGKITCSLIGGSEQQNKSNDNANKWIGYDDYTKGSLTTKELDVLSDTIILHINSVKLLEPFVKKYETQKGKDTLSEKQIDSIGKFLQLLNVFIEKFLNVYIQKHSLEKESPNDTSGTNSGKGFQADQNRLDRISVPPAKANYGPSKFGRKLKTYYPFLNSMLGQGMIVIFIFLHHKAKEFVENDPKTKLNNGFLQLIEKNLDTLLQFEFRLSTKYITTSRMWSSNMVYLINRVLNLINMIYEKQEELEREKDFDLEFEESDKQSLITMKSASSSEEPSNSTPPIPGIEDEFPITTAQGNLLYLFNTNSFGDPSQFEYLNGFHLNDPNWLTVLDNIPYYLDPLVDGSKEQIADYKQYGPVTETTNGNIDTSLEPVGADIMENLSTNGPSGSNSVNNTAIANGSGMDNSTTVSNTIDPVTAAAVAAGTTTSTNVIANSSTIPLQPQSKSSSTTPAIFNQSSGDGFGLNYYNNGSWTSASSNDSYTKCSRTTNVDSVPKLWNAPYHWNHEFQV

SEQ ID NO: 20146 - protein, 321 aa, Candida albicans
  UNSURE (41): Identity of amino acid sequences at the above locations are unknown.
QELHLVFSKLLVRMAKRLQKQFQLSTEKLLKGSSLLLSAPXTLANGQVIETTAGIVITTNKQGEKVTKPVPLEFTSTIEFSHHLTTHPVTLPNGQITVTTEGVIITRKGEQQFTKTVEVGNLPSKPIEVVQKISVVPKTLPNSQVTSETVAILVTVGEELQPITKTIPIGTSAQETEPSFAAYSEIVFTTCSEGGCNTYTTNVEVIGNKVITKQSGKPIVEEQTTNGIVHQSDKVYYTIVSGETKTIQTPGSIVSTSPAAIPVVTSKGSPNIVGSSVVAGSSVTTSEVSTSTAGVLQGNAASRQSFNYKFIVGLILAYIIA

SEQ ID NO: 20147 - protein, 457 aa, Candida albicans
IAITNDVDQAMKLALEHKGETIEVDSVQASKLLRKIDLYLLPVMCLLYCFQFMDKLTTSYASVLGLRKELKMQGDMYSWTATAFYLGYLVFEFPASMLLQRFPVAKTVSVFIILWGMILALHSVPQYPGFVALRTILGMLELSVTPAFTIITSQWYRKEEQFLRTAWWFASNGIGTIVGLAIAYGLFKNNGNYSLPAWKLVFVVTGCLTIFLGFIIMVHIPDTPAGAWFLTDEEKLMVVERIRTNQQGFGNTHFKKHQFIEALTDHRTWLFFLFALSGNIPNGGLTSFGTILLNEDFGYTPSKSLLIQMPQGAVEIVGCVLFAWVCKFFPSRMLMGIITTSIAVLANCLLAFCKGTSARLAGFYLNLLGPLGFICCLSCVSSNVAGHTKKVTTNAMFLIAYCVGNLIGPQTFISTQAPGYTGAKVAIVVCGFVSLFILIAIYVSYHIENLHNDVAGR

SEQ ID NO: 20148 - protein, 257 aa, Candida albicans
RQRERMVVERIRTNQQGFGNTHFKKHQFIEAVMDHRTWLFIIYSISSNLPNGGLTSFLAILLNGDFGYNLTESLLMQMPPGAIAVVGCIILAYCGKFTSSRLIMGMISQIVVIICNCLFTFAKNDKARLAGLYISAVGPVGFICCISCVSSNVAGHTKKITANAMFLIAYCVGNLVGPQTFIESQAPNYVGAKIAIVICSCVSFITLVLIYLSYYWDNKSRDIKARNSEDADLMNHIENYEFADLTDKENLNFRYSL

SEQ ID NO: 20149 - protein, 235 aa, Candida albicans
RLVRTSWWFAFNGIGTILGLAIAYGLYQNDGNYSLPTWKLVFIVTGCLTIFLGFVVLIHIPDTPTQAWFLTDEEKLLVVERIRTNQQGFGNTHFKKNQFIEALTDYRSWLLVIYALSSNIPNGGLTNFSGILLYEDFQYSEAKSLLMQMPQGAVEIVGCVLLAWCSQFISSRLLMTVFTTSLTIMSECLLTFYPEKSGRLVGLYLPMLDPLGFICCLSCVSSNFAGHTKKITTKP

SEQ ID NO: 20150 - protein, 220 aa, Candida albicans
QKMKQQDDLEKYQDIDTTNNDIKPIISFTKEDIEDGKNPKNHHVITTITSSDGKKINITNDVDQAMEAVLSNDNEPPINFDDISSTEWKKLLLKIDLYLIPIMCLLYCFQFMDKMTTSYASILGLRQELKMVGDMYSWTGTSFYLGYLVFEFPASMLLQRFPVTKTVSIFIILWGVILCLHSVPNQYGGFITLRTLLGMLELAVTPAFTIITSQWYKKEE

SEQ ID NO: 20151 - protein, 552 aa, Candida albicans
ITIKPTHSPSISSTHRKFYRLKNSKLVMSEKKELKNQTDIEPIISFTKEDIEDNKPHVLTTIISPSGKEIAITNDVDQAMKLALEHKGETIELDSVQADKLLRKIDLYLLPVMCLLYCFQFMDKLTTSYASVLGLRKELKMQGDMYSWTATAFYLGYLVFEFPASMLLQRFPVAKTVSVFIILWGMILALHSVPQYPGFVALRTILGMLELSVTPAFTIITSQWYRKEEQFLRTSWWFASNGIGTIVGLAIAYGLFENDGNYSLPAWKLVFIVTGCLTIFLGFIVMVHIPDTPAGAWFLTDEEKLMVVERIRTNQQGFGNTHFKKHQFIEALTDHRTWLFLLFALSNNIPNGGLTSFGTILLNEDFGYTPSKSLLMQMPQGAVEIVGCVLLAWLCKFLPSRMLMGITATSITVLAECLLAFCKSNSARLAGFYLYLLGPLGFICCLSCVSSNVVGHTKKVTTNAMYLIAYCVGNLIGPQTFISTQAPGYTGAKVAIVVCGFVSLFTLIAIYISYYIENKKRNSRPPVDMSHIENYEFADLTDKENPNFRYSI

SEQ ID NO: 20152 - protein, 62 aa, Candida albicans
LRNVGLCRGENVALLSLICLYFSYVWENKKRDSRTMVDMSHIENYEFADLTDKQNPNFRYSK

SEQ ID NO: 20153 - protein, 252 aa, Candida albicans
SCLRPLVKILCFGFQLATITLLPGETMRVVISKPKDWVASPGSYVFVSFFTPKYFWQSHPFTISTSTESTITLYCKVKEGVTQALYKDLLNSPNKTIKIRAGVEGPYGELSGAKTAESAVFVAGGNGIPGMYSEATHLASRRSIRSSKKIKLYWIVRDYRLVQWYYEELQLLQRTNIETVVYVTRPNDSLEEVASNFTSSNFDEKSCYSLGDSKTMISCNSKYTLNLKKDNNNNNNYHRVKELIKDELSHIL

SEQ ID NO: 20154 - protein, 574 aa, Candida albicans
TMLVSIFLLVFGLASTVLSSSNPYRYTPLDIAQYSCDAWISNHKPVCLLPVAWGGHNYDCYCNSNPAFATIMDCFINGYNNDSVIINEFAQTCNMTFESMFIKYYLTLNFNSTLLRNLSLAKRWGNTLTEDDLVKTPILYNYTNGSFAVYKDVYKLYYLNTNRSITYGGILLAYWAVILVLAIIVNLVLKMYLGCMINAFIGKVVNVYRKHIGLTPTFSKSKSKEVSIMGWFLLGTIPSRLESIILGGFFVVTIAVRAVNIHHIPNNPKEPIMAEELCDLIATRTGIVTLYLVPLLVLFAGRNNFMQWLTGWKFSTYMMYHRWISRVCLALVFIHGVTYTVVDKLNGTYATNMKTNNVIWGIVACVCGGFITFFGMLIFRRNYYEFFYIFHLLLVVFFIVGGVRHVVGLGYANYLWASIAVWVFDRVLRLFKLASFGVKTAHIALLANETIKVTIPKPKRWRPKPGGHAFVHFLTPSTFWQSHPFSFVIGGNDDEEIMFYIKVKDGITKTLYNRLSQCPGKISTIPVMVEGPYGGNSPGQRCRHLVYVAGGNGIPGLYSECIDVESSPRRGRQR

SEQ ID NO: 20155 - protein, 183 aa, Candida albicans
SKMYKGAAGMGSFLIISFCLLIPPFLWHIRSRNLPATILIFWLMYVDLTGFISTMIWSGDNFDEAWDGQVYCDIVGKLDAGSSVGKCCAIACVIMNLYFVLCAKHPTLLEQGSWKKFAMDMAICLINPIFVMAVHYIVTGSRYAIVKYQGCSTIYSATYASLLLVSIWTVLHGRSWQVPRLVC

SEQ ID NO: 20156 - protein, 210 aa, Candida albicans
GRGFPFRGEEHLLNKILHLEICGYVDRAGRPLVAILITNVFGLLSFIAASGKEDEVFTWLLSISGLSSIFTWLCICISHIRFRRALHVQGRNTDELTFVSQTGVIGSWFGILLNVLVLVAEFWLAIFPLGEKSNAKSFFETYLGFVILIIFYFGHKLWRNNWILFIRSRDIDIDSGRRETDLEALKRELQEEREVLRNKPFWYRAYHFWC

SEQ ID NO: 20157 - protein, 256 aa, Candida albicans
ARILPAPVVEDASPFVIAVSQGGIRVVPHIMNAVVVIAVISVGNSSVYGCSRTLASLAVQGLLPKSMGYIDRGGRPLIAILFTSAIGLLGFLVVVDDEGDVFTWFFSICSLSSFFTWGAINVVHLRWRFALAAQGRSTDEIIFRSPLGTFGSWTGILVLILIVIGEVWVSIWPIGSPADVQQFWKNCLSLPLMIVMWAGFKTYHRSWNMLWVKLKDIDLDTGRREIDVELLKQELAEERQIIKSKPFVYRIYKFFF

SEQ ID NO: 20158 - protein, 345 aa, Candida albicans
ISFIDSFREFDYSTLPPVYNNITDQESQLQLNPANPNFDYSHFTQLERDALITASSPLSKRLKTRHLTWISLGASIGSGLLISSGSSLAHAGPLGLLIVWIFVGSVIFATMSSLAELATAFPVSGSFTTYVTLFVDKSISFAIAWNYALQWLVTFPLQLVAASLAIEYWTIKIHPAIFVTIFYVCIVFINLFGVYGYAEIEMVVSIIKVIAVIGFNILAIIIVTGGVPGQPYIGAKNWQGPQGGLFNTIEPFKQMCHIVSNVAFAYGGVELFGLAAVETASPKKSINRARKQIFYRLMVFYILSIVMIGFAVSYKTPELQDSGAFGTDINASPFVIAIKQGVQQP

SEQ ID NO: 20159 - protein, 233 aa, Candida albicans
IKGLHSVINAVIMISVLSVGNASVYATSRTLNSLAEQGMAPKWTGYIDRAGRPLFAILITNVFGLFALIAADNEKQVVAFNWLLALSGLSSIFTWMSINLSHIRFRRAMKVQNRSLTELPFVAQSGVWGSYFGLTLNILYLIAQFYIGLFPVGGKPNAYDFFLAYLGVPVILASWIGYKIWKRDWTLFIRAKDIDLDTGRINVDLDLLQQEIAEEKAQLAEKPFYIRIYRFWC

SEQ ID NO: 20160 - protein, 304 aa, Candida albicans
YLQPFRQLGGEDMGWNYAMQWLVVLPLELVAAAMTVKYWDAKTNLAAFVVIFYVLIVAINFFGVRGYGEAEFIFSAVKVLAVLGFIILGIVLCAGGGPQGGYIGGKNWYIEGAPFPNGAKGVITVFVNAAFAFAGTELCGLAAAETENPRKSLPKACKQVFWRITLFYVICLTLVGLLVPWNDERLLGSSSADASASPFVISIRNAGIKGLPSVMNVVIMIAVLSVGNSSVYGSSRTLAALAASNQAPKIFGYIDKQGKTLVGIIAQLLVGLLCFLAASDKQGEIFNWLLALSGLFSISTWGIN

SEQ ID NO: 20161 - protein, 509 aa, Candida albicans
SYKMSRKSSIDMPKEASSPECYTTSTSSNEISEKPGMWRNFKDSFKPPVPIDDIENGSISSTQLKGGQNVPLQQSLKKRQLQMIALGGCVGSGLLVASGAALRNGPASLLIAWFIVSTFLYCTMQCLAELSSTFPVSGSFAVYSIKFIDPSWGTAMGYNYALFWVVVMPLELVASSMTIKFWPSNINTSVWVAVFYVLIIGTNLFGGTRAFGETEFVASVIKLLGIVGFNILAIVLICGGGDQGYIGGKNWHPPFTTGVKGVISVLLTATYSLAGTELVGLTSAEAAGDARKVLPKAIKQVLWRILIFYLLTLTLVGFLVPASDPQLIGGGSGASASPFVIAIREGGIKGLPSVFNVVVLVALLAIANSAVYGFSRTILALAEQGVAPSIFKYVDRQGRPLAGIATSAIVGLLSFVSASKQQEQVFDWLVALSGLSTFFTWGSINAAHIRFRIAMKVQGRSLDELPYKANTGVLGAYYGLIMNVAVLALQFWLAVWPIGGIFTTGENPT

SEQ ID NO: 20162 - protein, 114 aa, Candida albicans
KTGVLGGLNNGLLWKGGRNWHKQFLVRKGGQLGVKPRAQLIFLNNILVDVLVLAVYVIHKVVTRNWKFRVDYKDMDLNSGRSDIDIDILKQELEEEREAYKRQPWYYKFYQLWC

SEQ ID NO: 20163 - protein, 176 aa, Candida albicans
YFLSLTFIGLLVPSNSPQLLGASGTSASPFVIAIKNGGIYALPSIFNACILLSVLSVGNLAVYGCSRTIQSLGAQGLGPKIFAYVDRKGRPLGGLVMSAIFGLLCFLSAYHDEATIFNWLLSVAGLATIFSWFNIGLCHVRFRLALRKQGRSLQELTFTALPGVVYCRAGRIRAIS

SEQ ID NO: 20164 - protein, 577 aa, Candida albicans
SDDDDDGEGERRLGNGASLTKAQSHLVLPSKDETGGKKYTKRSNTLDTPQQNTSDGRKIRKKAPKRKTPRTQRNASFNQHSNVSIGDGSIENVDTNDSYQRLSRTMSGNYLSWTPTVGRNSTFIKLTDEQKEELGGIEYRAVKLLIKIIVVYYVGFNIIPGVMLLIWIYCMPHYINLMISSSISPAWWAFFTLQSSFNDLGLTLTSNSMMSFNQNAFVQILCSFLIVIGNTGFPILLRFIIWVMFKTARPLSLYKESLGFLLDHPRRCFTLLFPSVPTWWLFFILVVLNGFDLVIFCILDLHDDTFKGVDMGYRVLNGLFQAFCTRTVGFSVMDLSQLHAATQVSYLIMMYISVLPIAISVRSTNVYEEQSLGVYAKENAEGVDESAPSNYVGSHLRNQLSYDLWYICLGLFIICIAEGKRLKEQDLRFSIFAVLFEIVSAYGTVGMSMGYPGVDCSLSGEFNVISKLVIIAMMIRGRHRGLPYTIDRAIMLPNAAMKRHDRLQEEHAINRHNTMERTTTLGRVATFGNGPIDGGNNLLTRAITNIEHRLRNRRDGRSESLTVSEDPRYVVRTVSEV

SEQ ID NO: 20165 - protein, 446 aa, Candida albicans
HKTADISISNIGYLDRCTKDSSYQAMLYRVSGFYKRHTRNFTNIDYGYYIRNFIHHIASKIYPYAKVVLPNFRAAHYFYILTLVILGSILVYPVKTCAYIDVLFFTAGASTQAGLNTVNVNDLSLYQQIVLYLLATLATPIFIHGSLLFVRLYYFERHFDNIKERSLMDYRMRKSATLARLGSAPTMSSTRLNTFNNQVLGFQEREAEKGSSSSPQSSSSQTSQPVLTAYNDQGGNDIEHHSEPSDSDDDESGNGPVTFQEKIHFEEPQRPRSQRRHSRTDSGIKFSALPHPRRRKSIDPEDMYRSINMLQEHKKNQEAKSKGIQFLNIGSPVRRKSRSSNIEAFPEEDTNPLRGDEITPATNSVGTGNNDEDEDDILIIKPPIEIENSDEANPIFTKKKKLASQIQFKETPGKAKKWITTKTRKHYNPWTSKLKKTLSNSSKKAL

SEQ ID NO: 20166 - protein, 207 aa, Candida albicans
IPNDFLTVFDSVAIIVFIPIFERFLYPFVRHFTPFKPITKIFWGFMFGSGAMVYAAVLQHYIYKAGPCYDHPLDCPNGNHINIGLQTPAYVLIAISEILASITGVEYAYNKAPVQMKSLVMAMFLLTNAVGAAIGIALLSVSVDPKMVWTYLGLAVLCFIAGCLFLTLFKHYNKKEDEWNNLEYEANIEEAALMPVSSLTPSRKSIA

SEQ ID NO: 20167 - protein, 320 aa, Candida albicans
FAMSTEEKHLQTDVINSSTQGSHSVEKLLRDDEYAGDNLGSDIQIDDEGREPTDHEMETLRHVSESIPISCWLVAIVELAERFSYYGLSAPFQNYMQFTPEHSPKGMLGLKQQGATALSYFFQFWCYVTPILGGWISDTYWGKYKTIFVFCVIYIVGIFLLFITSVPSITSKSTATGGYIAAIIIIGLGTGGVKSNVSPLIADQIPKKKPYIKVTKKGERVIVDPNITVQNVFMFFYLMINIGSLSVIATTQMEAHIGFWSSYLLTFCFFFIAIAALIVGRNKYVKVPVGDKIVNKTFKCVWVGIINGVNFDAAKPSVKQ

SEQ ID NO: 20168 - protein, 271 aa, Candida albicans
  UNSURE (3),(12): Identity of amino acid sequences at the above locations are unknown.
SHXTPVRPVGEXENRGTLVCCFQLMITLGIFLGYCTTYGTKSYSDSRQWRIPLGLCFAWALCLVAGMVRMPESPRYLVGKDRIEDAKMSLAKTNKVSPEDPALYRELQLIQAGVERERLAGKASWGTLFNGKPRIFERVIVGVMLQALQQLTGDNYFFYYSTTIFKSVGMNDSFQTSIIIGVINFASTFVGIYAIERMGRRLCLLTGSVAMSVCFLIYSLVGTQHLYIDKPGGASRKPDGDAMIFMTSLYVSSLLLHGLVVFTPLFLNFIH

SEQ ID NO: 20169 - protein, 123 aa, Candida albicans
TWTSTRRADIGYFGSYACLTWVVPAESFSLGTRSQGMTICSALLYLWAFTVTYNFNRMKVAMTYTGLTIGFYGGIAFLGFFYQVLFMPETKGKTLEEIDEIFEKPSRQLIKENLSGLKRFWGR

SEQ ID NO: 20170 - protein, 177 aa, Candida albicans
TTLNNNSLYFYPNYFYIRFFNNNCLPPLFIMQFQTLLVVAGSLVASTLAVNSTVTEHHTTEITITHCSDNKCATSVAPAVQSVNTVTIEGVVTEYTTYCPLTASEHKHKESSSPSSVAPVASTESVVTTTISGVHTSYTTYCPLSGSSEASTVITPGTVAGESSSSSEEVVFTHGGW

SEQ ID NO: 20171 - protein, 441 aa, Candida albicans
  UNSURE (435): Identity of amino acid sequences at the above locations are unknown.
CPTLISFAGEDLGDIFNCIPHNTPPVCTDLGLYHDSSISLSGSKNKREAEIVNEDGTIEKRTFGSAGVNAGFNAAFVVSNAKKLSDGSYGIDCNFKSDSSVQLNLAFGKKVKQLSITGTGYSDISLLGNVANPFEWSASLKVKAEIVKGKCCLPSGFRIVTDFESNCPEFDAIKQFFGSSQIIYKVNAVSNAIGTFDASALFNAQVKAFPAKRELDEFEELSNDGVTHSKRTLGLLLGLLKKVTGGCDTLQQFCWDCQCDTPSPSTTTVSTSSAPSTSPESSAPSTTTVTTSSSPVTSPESSVPETTTVTTSSVPETTPESSAPETTTVTTSSVPSTTPESSAPETTPESSAPESSVPESSAPESSAPESSAPATETPTGPVSTVTEQSKTIVTITSCSNNACSESKVTTGVVVVTSEDRVYTTFCPLTETTPDXDPASGH

SEQ ID NO: 20172 - protein, 163 aa, Candida albicans
ISRVMFPRFWKLGGNGVVGGGPFTLGLFDTAGQEDYDRLRPLSYPSTDVFLVCFSVISPASFENVKEKWFPEVHHHCPGVPIIIVGTQTDLRNDDVILQRLHIQKLSPITQEQGEKLAKELRAVKYVECSALTQRGLKTVFDEAIVAALEPPVIKKSKKCTIL

SEQ ID NO: 20173 - protein, 66 aa, Candida albicans
LIYPYIMQTIKCVVVGDGAVGKTCLLISYTTSKFPADYVPTVFDNYAVTVMIGDESSPRAGKDQRY

SEQ ID NO: 20174 - protein, 253 aa, Candida albicans
SIMTTLSTIWLFLITITAIFQLGLSSNVTTIIDDDNNNNNNNNNNADDFLEPQIETIKVIGNKFFECESGHQFFIKGIAYQKTRQEGEIYDTTKEPHYIDPLANPFTCLRDLDYLKELGINLVRVYQIHPNANHDVCMNAFAEAGIYVLADLSEPTISIRRDYPHWDTEIFNRYQQVIDSMSNYKNLLGFFAGNEVTNCQSNIDASPFVRAAIRDCKKYINQQGYRKIPIGYASNDDANIRKNLANYFVCSIK

SEQ ID NO: 20175 - protein, 357 aa, Candida albicans
RPGYRDLTTMFKDYSVPVFFSEFGCNIITPRPFTEVEAIYGSTMKKVWSGGIAYEYFEEVNHYGILLTKKDGLITKLPDFDTLKMRFHAATPIGITMDEATICEPPICSNSVIDDKSSSSSFWDVALTLPPTPNEAKCECLWQSLSCVVSEDATFDEEVALRELCFKVDCEDINANGRSGKYGRYSDCNPTVRTSYALNKYYEQCGKKQEICDFQGRGELLPNRNGGLQDLENKFSSDGQNCLSLLEGKEEEKEVQEEEPGVPGLPGSNKGKEVENTPKRKGKGKSKEKEKEKGKLIEEEEEEEEEEEENNKTPSSGEKSPKTSKLIAGGNAITFKNDSIWKTFIEILFTCSAAILI

SEQ ID NO: 20176 - protein, 585 aa, Candida albicans
TYLPPFLGDITFTTYIIVFTKRWLVKFSFTLKKYPKGVVKPLSTDYLGTFADVEDPLERRRLALEEIDKAGFGWTQVKMILIAGVGFMTDSYDIFAINLSMNMLQYVYWNGTIPDSTTTLIKVSTSVGTVIGQISFGSIADKVGRKKIYGLELIIMIFATLFQCTLGTSPAINFVAIFSTIRILMGIGIGGDYPLSSIISSEFSTTKWRGAIMAAVFSNQGLGQVFAGIVAMICVAGYKDDLIIANKGSECVGRCRKAADQMWEIIVGFGCVPGCIALYYRLTIAESPRYALDVDEHDDLEKVADAEAAIDVHAQEIAPPKASFKDFCSHFGQWRYGKILLGTAGSWFMLDVAYYGLGLNTTTILQTIGYAGQSNVYEKLYNSAAGNLILVCAGSLPGYWVSAATIDTVGRKPIQMGGFILLTIILCIMGFGYHKIGNHGLLGLFVIAQFFQNFGPNTTTFIVPGECFPTRYRSTAHGLSAAAGKVGAIIAQTCIGTLVNHGCSKENKNCFLPHVLEIFALFMLLGIGLTFLIPETARRTLEEISETCHGEVDTTKLGRDRFATQEEPYDSAEVKMFHNAVRIHL

SEQ ID NO: 20177 - protein, 191 aa, Candida albicans
  UNSURE (5): Identity of amino acid sequences at the above locations are unknown.
GGMTXNRRLRRVKESSPLPTLRIKKGDRVQLYLINGFDNLNTTLHFHGLFQNGTNQMDGPEMVTQCPIPPGETYLYNFTVDQVGTYWYHSHTAGQYGDGMRGVFVIDDDDFPYDYDEDVVLTVGDHYHKYSSDIIPSFLSRFNPTGAEPIPQNFLFNETRNLTWKVEPGKTYLVRIVNVGGFVSQYLWMED

SEQ ID NO: 20178 - protein, 608 aa, Candida albicans
GPLILGSGTIHRFDWNVSYVMANPDGIHPRRMIGINNQWPNPTIRSKKNDRVIINLTNELPDKNVSLHFHGLFQRGYNDQDGPAFVTQCPISPGVTFTYDFNVTDQSGTYWYHSHMGSQYGDGLRGLFIIEYDNDDEYNKEFPYEYDEDVTLSVGDHYHLESPEIVKNFMTRFNPTGAEPIPQNGLFNETKNVTWQVNPDTTYLLRIVNMGLFTSHYVYIEDHTFTIVEVDGVVVEPYETDSLYVAVAQRYVVLMKTKKSADKNFRFVNVLDQDMLDFLPLDLQIVSTNWIVYDKSLELPPALPFNQFHKTIKSLVGFDDFDLRPLRKVNLLDEPDYTIQVNLTMEVLGDGVTYAMFNGKTFRPPKVPSLYTVLSTHGNTNLTTNELIYGTNTNSFVLQGDEVVEIILNNMDPGKHPFHLHGHNFQVISRFDTDDEDNQLVFDPTNETYTNYPEFPMVRDTVEVGPNGFIVLRFKADNPGVWFFHCHVDWHLEQGLAILLVEDPLELLSSNTTIPQNHIDACNAIGMPIKGNAAGNDIDLLDLYGENIQPNPLPAGFTNKGYLAITCCTLIAIYGLWSIYNYGMEDISKDNAEDVIEKLYKILDDYDK

SEQ ID NO: 20179 - protein, 320 aa, Candida albicans
MQRMSIPMDDMLEDFNLKPLDKEKLVDDADYTITVDVQMDNLGNGVNYAFFNNITYMTPKVPTLLSVLSAGDASTNELVYGSNTNSFVLQGGDVVDIVLNNLDTGRHPFHLHGHVFQLIERHEEIPDTEDPVSYNVSDHAEWPEYPMSRDTVYVKPQSYIVMRFKADNPGVWFFHCHIEWHLDQGLAIVLIEDPEAIQKNSSQHLTDNHKQICEKVGVSWEGNAAANSNNYLDLKGENIQVKRLPTGFTARGIVALVFSCIAAFLGIAAIAYYGMNDIEDVEERVARDLDVDLDEENEDEEEAEIVNEGSSSSGSNSKQH

SEQ ID NO: 20180 - protein, 576 aa, Candida albicans
QLGDYYLSQNKNYIYTQKEGTIFKNMRSLSIFSLVFLFFSTLITAKTHTWYYKTGWVNANPDGGFERPMIGFNDSWPLPTLRVKKGDTVNLYLINGFDDRNTSLHFHGLFQHGTNQMDGPEMVTQCPIPPGETFLYNFTVDDQVGSYWYHSHTSGQYGDGMRGVFIIEDDDFPYDYDEEVILTLGEHYHDFSDDLHKNFMSRYNPTGAEPIPLNILFNETRNNTWKVEPGKTYFVRIINIGRFVSQYVWMEDHEFTIVEVDGIYVEKNTTDLIYITVAQRYGVLITTKNSTDKNYAFMNRVDIDMLDVIPDELELNGTNYIEYNSKADKPEPYLLDSIDDYFDDFYLKPLSKEKLLDDADYTITVDVQMDNLGNGVNYAFFNNITYTTPRVPTLLSVLSAGDDASNELVYGTNTNSFVLQSGDVVDIVLNNLDTGKHPFHLHGHVFQLIERHEEIPETEDPVGYNASDHADWPEYPMLRDTVYVRPQSYIVMRFKADNPGVWLFHCHIEWHLDQGLAIQLIEDPQGIQKNTSQHITDNHKQICEKVGVSWEGNAAANSKDYLNLSVHDGSGRTAGM

SEQ ID NO: 20181 - protein, 393 aa, Candida albicans
  UNSURE (383),(387),(389): Identity of amino acid sequences at the above locations are unknown.
VVKTASLIAAETHTWYFKTGWVDANPDGVYPRKMIGFNDSWPLPTLRVKKGDRVQLYLINGFDNLNTTLHFHGLFVRGANQMDGPEMVTQCPIPPGETYLYNFTVTDQVGTYWYHSHTGGQYGDGMRGVFIIEDDDFPYDYDEEVVLTLSDHYHKYSGDIRPAFLTRFNPTGAEPIPQNFLFNETRNATWKVEPGKTYFVRILNVGGFVSQYLWMEDHEFTIVEIDGVYVEKNTTDLIYITVAQRYGVLITTKNSTDKYYAFMNGVDTTMLDSVPVDLQVNGTNYIVYNESSALPDAYDIDSYDDALDDLYLKPLSKQKLMDDADYTITVDVQMNVLNDGINYAFFNNISYKAPKVPTLLTVLSAGEVATNELIYGTNTVPFXLRAXSXNYPV

SEQ ID NO: 20182 - protein, 186 aa, Candida albicans
LETTMSNPYQNSQNGYQQNNSYELNNYPNKQYSSSNEDDFVQFMNEIQDINSQLDNYSNIINLIDNKQKNFLHGLDLNDEDTDYDSKQIENLVNEAQSLQLDLKNRIKNVQTQAVHSRDQTKVDQAETCRKRFLDLIQDYRLVEARNKESTKEQAARQYQIIKPDATDEEIKAVVEDDLNNASNKH

SEQ ID NO: 20183 - protein, 250 aa, Candida albicans
NSDFFFWFFVFSYFILFYFPTDNMNSKEIRIVALLILDTVFFLLEAIIGYTVHSLALIADSFHMLNDIISLIIALWAVRVKNTKPADGKYTYGWQRAEILGALINAVFLLALCFTIIMDSIQRFFEPQEISNPKLILIVGIAGLVSNGVGLVLFHEHGHSHSHGGGGGGGSDHSGDSKSHSHSHSHSHGEATTFSQGDEEEHIGTEENEHTPLLYNITHTTMKSTPSEVFDYLPDNVVESFHTGPEGPQL

SEQ ID NO: 20184 - protein, 256 aa, Candida albicans
KTLKILAGFTNGTLLVGISGSILFEAIGRLFNPVHLQKTTELIIVSILGLLVNLVGIFAFNHGHSHGHSHGHSHGSSHSHEHSHGHSHEHLHAPNCDSEDEHDHMNDNMKGIFLHIMADALGSVGVVISTILTKYFSWDGFDPIASIIIATLIFVSAVPLIKSTASTLLLSISKTKEDQIRNILHEVQQVKGVRSLTTPRFWPGPTNNVCGYVHIQVYRGENTSYIKRQCEKMFESRNMDVMLQIENDYDDCWCRK

SEQ ID NO: 20185 - protein, 244 aa, Candida albicans
VARVLPAPVVEDGIAYQQNNLDSNESFVDPLANPEHCKRDIPYLEAVDTNVIRVYALDTSQDHTECMQMLQDAGIYVIADLSQPDESINRDDPSWDLDLFERYTSVVDLFHNYTNILGFFAGNEVTNKKSNTDASAFVKAAIRDTKAYIKSKGYRSIPVSYSANDDSAIRVSLADYFACGDEDEAADFLGINMYEWCGDSSYKASGYESATNDYKNLGIPIFFSENRCNEVRPKKIHRSGYSFW

SEQ ID NO: 20186 - protein, 529 aa, Candida albicans
  UNSURE (7): Identity of amino acid sequences at the above locations are unknown.
MKLCPMXILFQTSTDYASENSFAISESTFITASDFQATESLVTESYFSKLQSSDSESFVINTSSAVDNSYVSSSSSAGGSSFPEETHMLQTSDSDLSSTAGSESDVTEFSDVSLATASDSSIADKSIGTESLYSEISLVSASESTGSIGELSISGDTLLKTASETKFVKSSFLSDLISETSSELFVSSSVSTDMILETANDSFITSDKVVETPSYSNELAFETVSETIINSFVSSESSLNTASNSLIASKPSTDSSSYTTDIDFETTTKSFAESPSYFSETVSEIASKSSLSMVEPSCWSELPFETSIESLIAPSYISSEPAPETASESFIVKPSYSEIASESITKSIISTIEASISSDIFSDATTGSIVVQPSVSSGISLEIPSESMLFSESSISKPFISSQSIHECTSDSILVVPSFFSSDVSFETVEYSSTVSTSVDAEPSYSSEISLKTPSESFIVSETFLEPSYSGEVVLATPSESVVASETDVYKPSYSNETVLQTPSESYILSETGVKESSQSSEFALSTPN

SEQ ID NO: 20187 - protein, 355 aa, Candida albicans
TTLSTFAPSSSSSEIAPEYTSTWEIGSSNESNVVEYSIVNQSNESLTNSVSSYEPATESAIVSPSDQVSTSSATSFVSASEFSAVTTTTVDSASASSSTDINNDVTVLVSPSESEINTSSSIWNNENNVSGAVSTSESTSIANNHDGSLSMTKTELEINGFYSTESSTMFVTATITSCNKSDCFENVVTYVSNDSYTTVTTGHSNDNTSVDNNNVPSTLIENVSNTETIPVVTNTEEVSTTVYNPLTSTSTSNIVESSNTSIVDNENNGVHINSDDMTAMVTAVETGNGITNGTNFVSPSTIPNEISETGSPATSIVGTLPYENGSNQLSIENIKYLILVVFGLSLHHGLEGPRL

SEQ ID NO: 20188 - protein, 198 aa, Candida albicans
DGVSTTLSLVMKESLAVSRIISVETDELTNNSLEVSEIKSLRKDDLTNLVSLAVLSNVSPEIESSPIEPVDSLADTKDISEYKDSVPIDLSAMEESLAVANDTSLNSVTSDSLPAVEDKSLSDVCNICVSSGKDDPPALEELETYELSTAEDVLITKDSESLDCSFEKYDSVTNDSVAWKSLAVMKVDSLMAKEFSLA

SEQ ID NO: 20189 - protein, 332 aa, Candida albicans
  UNSURE (318): Identity of amino acid sequences at the above locations are unknown.
PLALIMIPRFILLLFLIMNSSYCEPFEFDFFQNLDPSTNLTEIINNNNNSISNNVFKVQNFDSKSSSSSSSSSSSGEGLQEFTPIRDTIIQSETKYYSFSVNTKSGIGDFYELLIFLSGNICTQPLNLLENDTSLAVYYSFNSTMFTNNEIGQMQLFKDGFFQGLADLPLTETTTTTNNDTTTTTVPEKILYIAVRAPENTNRTAQWTYQIGVSQHDLVFQWDDRSWGSIVDVDDNSALIVTGNLTKLSLGNYLDLNATNSQFSLYLYSYDNKDYFQGMNNSWCAVRSGPVLVKPEEIDTQFIARHGSIQQQFMVNNXNASTKYIGLYCYGV

SEQ ID NO: 20190 - protein, 245 aa, Candida albicans
MLVQNILAYIVMESEGVEYGGAVLRPFEFETMDGTACELIYDLEFCDQVAYSVPAIGNSLLLASSIAGADNKTLTKKLYDDYAKSLYTNFLKGLQQIACDTVPEAIYSNLKSCQDCAQSYKNWLCAVTIPRCSTKNFTGYIHRNETNQRNEFLADVIQPNQDYYEVLPCVNVCQAIVRDCPANFGFLCPTKNDSIKLSYYWDVHVSDQWPSCNYLGPLRSSKSGTIKLIINWTIVVVSFTLMVVI

SEQ ID NO: 20191 - protein, 233 aa, Candida albicans
FSSGGDDDGSTDDVFASPFLIGLINMGMSSSSFLLGFFNFIILISMVSAANSNIYFGSRCLLSMVEEGYFPVVFGETTKNGVPFNAILLTSSIGLISLLSKFKSIDIFYKLLINLSSTSGLIMWLFILISYLQFRRALAFNSIVYETLAYTAVHKFPMIKLSYITIVSIVTIIIGNGIVNIWEFSWDLFISCYLTLIILIVGSVWLSVIWKQPILKKIEDIDIFTNQSVHAFK

SEQ ID NO: 20192 - protein, 143 aa, Candida albicans
VLLSFCRLCKNVIGVVSIRFRRGLEKQGRTHELLFKNWSYPYGPLYVVILGGFIILVQGWTTFSPFSVNDFFQSYLELGVFPLCFVFWWLVVRKGKDKFVKFEDMDFDTDRYYETPEEIEKNRYANSLKGWAKFKYNFADNFL

SEQ ID NO: 20193 - protein, 240 aa, Candida albicans
VPSGNSSMPFIETHASYTNLLPPIVGLTWMLVDCFRPVVKWSTVGLCKGAIAVLVGITPAAGYVPVYTSVIFGIVPAIICNFAVDLKDLLQIDDGMDVWALHGVGGFVGNFMTGLFAADYVAMIDGTEIDGGWMNHHWKQLGYQLAGSCAVAAWSFTVTSIILLAMDRIPFLRIRLHEDEEMLGTDLAQIGEYAYYADDDPETNPYVLEPIRSTTISQPLPHIDAVADGSSNNDSGEAKN

SEQ ID NO: 20194 - protein, 76 aa, Candida albicans
SAVNLPVVGGYYLQMHKFGKGIIFGVVGAISGNLATRLKYFFNIDYALDLFAVHGIPGIVGSMLTGIFANDLYDSK

SEQ ID NO: 20195 - protein, 129 aa, Candida albicans
LITNMSGNFTGTGTGGDVFKVDLNEQFDRADMVWIGTASVLVWIMIPGVGLLYSGISRKKHALSLMWAALMAACVAAFQWFWWGYSLVFAHNGSVFLGTLQNFCLKDVLVHHLLLKPCPILHHGAGRNH

SEQ ID NO: 20196 - protein, 163 aa, Candida albicans
  UNSURE (28),(41),(52): Identity of amino acid sequences at the above locations are unknown.
FTKLIFKMGEIVVGVVVKQTSGSFSFFXGLLLVLLLPLVFXTNLFDNSVGSXSNSPILLPPNANRNPSPPNLFLSTNSSNNNNGSPLMGASMTPTSTSFLNNSPSLVTTGPISSNTWSMGVSTPTSGSIWGNKFSGTSTTLTATPITKTSSNVMSSFNGSNLW

SEQ ID NO: 20197 - protein, 685 aa, Candida albicans
RSSVAGDETSESSVSVTSESSESVTSESVASESVTSESVTAVSDISDLYTTSEEVSTSDSNSGMSSPIPSSEQRSSIPIMSSSDESSESRESSIGTILSEESSDSIPTTFSTRYWSPSGMSSRHYTNSTETLVSDVVLSSVAGDETSESSVSVISESSESVTSESVASESVTAVSDISDLYTTSEVVSTSDSKIVPSTSVPSSEQRSSIPIMSSSDESSESRESSSGTILSEENSDSIPTTFSTRYVSVSLTVGELSALPSLPGKLSHLPSSLSETSIGMTKSANLLPQFFSTSVDSALLYWALGSSSADHQSSATCDVSESSVEGNLSAMALGMSNSDDGLSEDTRSSSVAGKEEIELTLTNSVGEITLISYSSSSPTTHDHGRVSKSMGAAPLSSLFSVSVHAPLVTGLLDSDTFPSENSNRSRSFKESTDNTISISRESLGNPYSSISSPSDYDVKLFTTSRELVSSESILPFSDVMDANDMPTSGSNLHSMVFSISVLGEKFNANIEKHKNTNGHYSSMVFTYQSAGLEESDQRIAVTNTKFDQNKIDTTIDSNTFVTSLPFATTLNDQIDQAVPIKIPASSTAGFVSDVLKPDYSKSVQAESVQTDSTTYSEMMSSKRNKNSGFGTSSLNLKPTITVVTKSIDTKVNTMKEGGVSKQVSTTVTAQYDTSTFFTTGLEDQR

SEQ ID NO: 20198 - protein, 221 aa, Candida albicans
  UNSURE (28): Identity of amino acid sequences at the above locations are unknown.
PTIAVLGSRVFPSLHHLPTIKIYQEFNXEDVSSSQIQHRVTSKNLKSLENSTLTKPTSRFDSNNYNGTNSSLVSTESEYQNDLIDAESLDTEGDDDIIAAPLPLDYTDPFSRPLSRNSTTSCLSTTATKDGIEGRRFRRHGPTAYSSHIIAGMMQQQQQQQQKLLNQQNPTKSLLNNDDEHYTLLDSTNASVASLHQTSIYPGTRSSSGSEPTVSSNVKEE

SEQ ID NO: 20199 - protein, 434 aa, Candida albicans
IPHYNRNIQTKKLNMTSQYNGDTNSTTIDPNNREGGLVIDQSNNLPSSSSSSLNHSHFQKPQVSNLTKNLLSSSGGQTTPVATNVNSNTASNQQNLFTNTPSSYTEPITNRVLPNLKASASQMSNSFSGSFHQSHVHNHNDSINYIPSSHNTPTAVSSSYTSHHSYPASLSSVNNFISQPSQQQQQQPIPLSFKPPGVVPNSIPTTNVHNDTANRFSSVSSTGSPFSNSPFATSTQFQSPASIAQPVHPSSLQQVQQQRFPNSFPNTTVTHFPNPPNLQQLAINRTQHNNNNHNHHHHHQQQPIVTDTLVSTSGSTTPVENQRPAVKSVQSTPSLPHGNQHDQSARSLALSQSFQTYVQPEPDHYMTYSEFLHNLSVKDSQDESAAYEEHLNIVEYPVNDLIIMLSCLLTKIIEANDKLHPNHFENTIAIRQRL

SEQ ID NO: 20200 - protein, 221 aa, Candida albicans
QEKLIDDQFGRRHSSVSSTIFHNQKNVSHPNLLLVHSARTSVSGPSGSNYGTGSPSYNGSPLLMSTAASRNNSITHFELINNSTIPSRRSSTFNSDLFPNPLAKENNNGNDNHKRRESQNSSFNSPMLTPLTRFSVSSMTSVHNSTIHNYNSSSVTSPTTSFKNAYSASSTSINLPVEEEEPETGVDKQKINEPSKDEVTAEQNGDEKVGKKRMAVSSLLD

SEQ ID NO: 20201 - protein, 705 aa, Candida albicans
  UNSURE (120): Identity of amino acid sequences at the above locations are unknown.
TNKVMSAQSTPKKEYSNDSRPQSTENDTARSKRGGKDSQPPPFHNSTVTRSSLPNNPRPASTGNIPRNTSTPSLNKKQANRLKTHNRSLSHNKSLTKLSTSTGATARPHLNRSKSTEVLXKSRQGGALKRNSRSLTKMTALQPMTKTTSSPTLPTHKSTTSLKNINSTCSIGLKSSARKGKAILQLNDDDADYEDVENLLNDEDTGENNAPVPERFDSQDTISTTHLQDEQNIPSLYEQINRILPEPTPASEEPPKFKDKLEVVEEGNTIDSKVNTSHPELGSSTKSSTDDFSQANNFYSGSLLLSQSTGLVRKIDPKHSANLKMTEAYPAMPSDEALNSTAISGISFKANPMELNNAAEPVTTSKNVSQNNSYQPDQTIFNNLQRTNNQYLMNKKQQQQQKTQQKSQQKQQQVKPLSPAGTAINNGTNNFSDFLRTNNSTSSADLQYGHNIETRTQQRLWLQRESSLMDVTNLDANRMSNFSNLSLNNLMFSHNYNNQSQANIRDLQYSGSVPQQHQPLTPMTPATPGVGNNGSYPGSDVNGNQGLLNLVQGTLPHTVQTKIEFERLNREYLNVRRHANPMGESLKRLESYSGKELNVSKTRKGDKSTTDANASTFEEFSPTFHEKETEISNTLSKLWQDAIVSSLSSSAARPTQPATQHHPTNQRSINPRLASYNQNYNNSRQNQAPNTRAVKLAPIQTTDAA

SEQ ID NO: 20202 - protein, 215 aa, Candida albicans
GSSYTTASAFVHASSASEEQFISVWDTSNSGGSLILESSTSVASVVTTPLPFTSNDIITEISSTWNGAKSDSPHTSESDITSQYNSHSTSVATRSDSISLTDTFEIGFASTWTTGGSGNGGSMKSDVSNQDSYATMLPTSFLDTSNSDITTGVVSTWDAKNSNSYTSAELSTDPYSSDGYASSATAALSITESIPTTDTINTEYHSVSPRPGRTA

SEQ ID NO: 20203 - protein, 70 aa, Candida albicans
NITPTGTFSFFAGLCFIAFFFVYFLLPDTAGLELEETTDFLSNGFNVKQAAQLSKERKKHSKFAKSKPTV

SEQ ID NO: 20204 - protein, 454 aa, Candida albicans
  UNSURE (405),(414),(423): Identity of amino acid sequences at the above locations are unknown.
PTLQFYIKGIDYQPGGSSAVSELNDPLSDPDKCARDIILFQELGINTIRIYSINAHLNHDKCMTMLAKAGIYLFLDVNSPLPHHHLNRYEPWNSYNLYYFENVFKVVEQFSHYNNTLGFIAGNEIVNDPISASVAAPYVKAVVREIKSYIEYNAPRTIPVGYSAADDLNYRMPLAQYLECGDDNPKESVDFYGVNSYQWCGDQTFYSSGYNILVNDYKHFTKPMFFSEYGCNEVLPRNFDEVPVLYTNDMIDVFSGGLVYEFTQEPNNYGLVKVLSNGDVKVLRDFIQLKNKFDTLPELDYSYIIQSMKENAKDIHQKLTTFKTSIPKCELLYPNLDISRGVPPTIAQTLIETGVDAKRGEYVTLSNEDLTTTYKFFEESGEKLAIVNRIETMVEVDEKALENRXTPQVPAEHXEPAEPTEPXEPRSPPRSTPFIDFIHKLIDPFKTFCANLFN

SEQ ID NO: 20205 - protein, 485 aa, Candida albicans
TPLTKILKSQQITHSFSFLARPNITNFNSFVHFSMLFRSLVTYLSLVSSVLSIASIKVEGNAFWDSESGDRFYIRGVDYQPGGSSELEDPLADTNVCERDVKYFQELGINTIRVYSIDNTKNHTECMDTLAKAGIYVILDVNTPHSSITRSDAACSYNTDYLQEVFASIVEFAQFDNTLGFFAGNEVINDGPSLEAAPYVKAVVRDMKTFIKNRGFRTIPVGYSAASVDEYRLPSGLYFNCGDDDMARIDMYGINDYSWCGDASMTTSQYSQQMKDFANYTVPLFFSEFGCNAKRPRPFSEIEAIYSTEMSSVFSGGLVYEYSEEASNYGLVELKGDSVTTNDDFDNLKSQFEKTKNPSGDGGYLKSTGGNKCPPKSNIWNVTEEIPDTPKGALKYLKGLAEPTGHGFDAYVQGNCNAKGNNVDDTGNYTSSITASSRASPSQTSQVSSSSATSANSTSSKKNDAAVEGAGFLSVIALAAGIALL

SEQ ID NO: 20206 - protein, 118 aa, Candida albicans
TLDLSRAVVEYEHEYVVIEPPAGQTCQEYMLVFITMHGGYLLQSNNGAAESGTCSYCTMDETNTFLKSVNALFSQRWRNYGIFNAFIVINVALAIFFYWLARVPKGNRESRIKHRKEE

SEQ ID NO: 20207 - protein, 491 aa, Candida albicans
GWNYLPNFNWWLFLGEPNSRFRFSKLTVRFVYLMRKLAILGQAILCSIHQPSAIIMAEFDKLLFLQKGGRTAYFGELGENCQTMINYFVIYGADPCPKEANPAEWMLQVVGAAPGSHAKQDYFEVWRNSSEYQAVREEINRMEAELSKLPRDNDPEALLKYAAPLWKQYLLVSWRTIVQDWRSPGYIYSKLILVISSSLFIGFSFFKSKNNLQGLQSQMLAVFMFFVPFTTFIDQMLPYFVKHRAVYEVREAPSRTFSWFAFIAGQITSEIPFQIVVGTISYFCWYYPVGLYANAEPTDSVNSRGVLMWMLLTAFYVYTSTMGQLAISLNELIDNAANLATTLFTLCLMFCGVLAGPNVIPGFWIFMYRCNPFTYLIQAILSTGLANAKVTCAPRELVTLKPPMGETCSSFIGPYTEAAGGYFSTNSDGTCSVCRIDSTNQFLESINALFSQRWRNFGIFVAFIGINIILTIFFYWLARVPKGNREKKMKK

SEQ ID NO: 20208 - protein, 70 aa, Candida albicans
LLFINVLKMPMIYLIKLLSCMKVIKFCFGKATKAKEYFEKMGGKCPQRQTTADFLTSLTNPAEKEPLPSL

SEQ ID NO: 20209 - protein, 393 aa, Candida albicans
KVKNEKIMSDSKMSSQDESKLEKAISQDSSSENHSINEYHGFDAHTSENIQNLARTFTHDSFKDDSSAGLLKYLTHMSEVPGVNPYEHEEINNDQLNPDSENFNAKFWVKNLRKLFESDPEYYKPSKLGIGYRNLRAYGVANDSDYQPTVTNALWKLATEGFRHFQKDDDSRYFDILKSMDAIMRPGELTVVLGRPGAGCSTLLKTIAVNTYGFHIGKESQITYDGLSPHDIERHYRGDVIYSAETDVHFPHLSVGDTLEFAARLRTPQNRGEGIDRETYAKHMASVYMATYGLSHTRNTNVGNDFVRGVSGGERKRVSIAEASLSGANIQCWDNATRGLDSATALEFIRALKTSAVILDTTPLIAIYQCSQDAYDLFDKVVVLYEGYQILLW

SEQ ID NO: 20210 - protein, 694 aa, Candida albicans
KILSLYEARPIVEKHRKYALYRPSADALASIISELPVKLLMTMSFNIVYYFMVNLRRTAGNFFFYWLMCALCTLVMSHMFRSIGAVTTTIATAMSLSTVFLLAMIIYAGFVLPIPYILGWSRWIRYINPVTYIFESLMVNEFHGREFECGQYIPSGPGFENLPVENKVCTTVGSTPGSTVVQGTEYIKLAYQFYSSHKWRNFGITVAFAVFFLGVYVALTEFNKGAMQKGEIVLFLKGSLKKHKRKTAASNKGDIEAGPVAGKLDYQDEAEAVNNEKFTEKGSTGSVDFPENREIFFWRDLTYQVKIKKEDRVILDHVDGWVKPGQITALMGASGAGKTTLLNCLSERVTTGIITDGERLVNGHALDSSFQRSIGYVQQQDVHLETTTVREALQFSAYLRQSNKISKKEKDDYVDYVIDLLEMTDYADALVGVAGEGLNVEQRKRLTIGVELVAKPKLLLFLDEPTSGLDSQTAWSICKLMRKLADHGQAILCTIHQPSALIMAEFDRLLFLQKGGRTAYFGELGENCQTMINYFEKYGADPCPKEANPAEWMLQVVGAAPGSHAKQDYFEVWRNSSEYQAVREEINRMEAELSKLPRDNDPEALLKYAAPLWKQYLLVSWRTIVQDWRSPGYIYSKIFLVVSAALFNGFSFFKAKNNMQGLQNQMFSVFMFFIPFNTLVPQIFTTRVAGPRLS

SEQ ID NO: 20211 - protein, 626 aa, Candida albicans
HWFSILFFWLPFNFKSNQTTTVDNKILQKPENSQPMVNIQPQNATEYAVNQSCEHITTPASSEYEGFDHNEVRQLAKILTNDNDDSAKSSLVRQLSNMSNVPGVNPCDANNLLLQLNPNCDQFDSKLWIKNLKKLYESDPEYWQHSKLGVAYTNLRVYGIANDVDYQPTVTNLLWKLGGEAFRKYFRKNDKTQYFDILKPMDAIMRPGEPTVVLGRPGAGCSTLLKTIAVNTYGFHVGKESKICYDGLTAHDIEKHFRGEVIYSAETEVHIPHMTVGDTLEFAARLRTPQNRGDNIDRETYAKRMADAYMATYGISHTRNTKVGNDIVRGVSGGERKRVSIAEVSLSGAKIQCWDNSTRGLDSATALEFIRALRTSAKILDCTPVVAIYQCSQDAYDLFDNVSVLYEGYQIFFGKASKAKEYFEKMGWKCQPRQTTADFLTSLTNPAERQTLPGFEDRVPRTPQEFESYWKRSPEYSELMGQIDGYFVDCETLNTKEVFHQAHVAKQSNHIRPSSPYRVSFFMQIKYLVGRNFKRLKGDPSLAIFRVCGQIIMGLILSSVFYNLQSTTESFYYRGAALFYAVLFNAFSSLLEVMTMYEARPVVEKHRKFAFYCPSFSPRHGRPRLI

SEQ ID NO: 20212 - protein, 740 aa, Candida albicans
  UNSURE (740): Identity of amino acid sequences at the above locations are unknown.
KHMSTANTSLSQQLDEKPWVDALDNSSVQEYQGFDATASHNIQDLARKLTHGSTNGDHHSANDLARYLSHMSDIPGVSPFNGNISHEQLDPDSENFNAKYWVKNLKKLFESDSDYYKPSKLGVAYRNLRAYGIANDSDYQPTVTNALWKFTTEAINKLKKPDDSKYFDILKSMDAIMRPGELTVVLGRPGAGCSTLLKTIAVNTYGFHIGKESQITYDGLSPHDIERHYRGDVIYSAETDVHFPHLSVGDTLEFAARLRTPQNRGEGIDRETYAKHMASVYMATYGLSHTRNTNVGNDFVRGVSGGERKRVSIAEASLSGANIQCWDNATRCLDSATALEFIRALKTSATILDTTPLIAIYQCSQDAYELFDNVVVLYEGYQIFFGKASKAKEYFENMGWKCPQRQTTADFLTSLTNPAEREPLPGYEDKVPRTAQEFETFWKNPPEYAELTKEIDEYCVECERSNTGETYRESHVAKQSSNTRPSSPYTVSFFMQVRYVIARNFLRMKGDRSIHIFSVFGQLVMGLILSSVFYNLSQTTGSFYYRGAAMIFAVLFNAFSSLLEIMSLFEARPIVEKHKKYAFIRPSADALASIISELPVKLAMSMSFNFVFYFMVNFRRNPGRFFFYWLMCIWCTFVMSHLFRSIGAVSTSISGAMTPATVLLLAMVIYTGFVIPTPSMLGWSRWINYINPVGYVFESLMVNEFHGREFQCAQYVPSGPGYEDISRSNQVCTAVGYVPX

SEQ ID NO: 20213 - protein, 240 aa, Candida albicans
  UNSURE (7): Identity of amino acid sequences at the above locations are unknown.
LRLQNAXKNIQPFINAIFFSGAFMSFMSVAYIPSYLEDIQSYKKERMNGLYGPLAFSLANFLVGLPFLFLIAAVFSVITFFMVNFHQTASGFWYYLMWLFLDLVAAESMTTFIASVFPNFVVSLAITAFANGLWMAVGGFLVPSNILNVFWYYTFYWIDYQRYVFQGMIFNEFTNREFRCGDGCHCMYDSPLASQCKISGKAVLESLGYGNYDKGLWIGVLIALVFVYRFATYIVLKLRK

SEQ ID NO: 20214 - protein, 602 aa, Candida albicans
SFLGFERGFFQPRGEDTEGIRLVNGRPLDSSFQRSIGYVQQQDLHLETSTVREALEFAAYLRQPKSVSRKEKNEYVDYIIRLLEMEQYADAVVGVSGEGLNVEQRKRLSIGVELVAKPKLLVFLDEPTSGLDSQTAWSICKLIRKLADNGQAILCTIHQPSAILLAEFDRLLFLQRGGRTVYFGDLGENFTTLINYFEKYGAPKCPPEANPAEWMLEVIGAAPGSKANQDYYDVWLKSSEFQEMNLELDLMLEELVKKPLDDDPDRLKPYAAPYWEQYLFVTKRVFEQNWRTPSYLYSKFLLVVTYSLFNGFSFYKADRSLQGLQNQMFSVFMFLVILHTLIQQYLPTFVSQRDLYEVRERPSKTFSWITFIAAQVTAEIPWNIICGTLGYFCWYYPVGLYQNATYTNTVHQRGAFMWFAIVLFFIYTSTMAQLCISFLEIDDNAANLSVLLFTMCLAFCGVLVTKEQLPGFWVFMYRCSPFTYLVSVMLSVGLVDAPVTCAAKEYLRFSPPQGYTCMQYMEPYMKVAGGYLLNENSTTECEFCTMKVTNVFLKMIGSDYSKRGRDIGIYIAFIGINIIGTFILYWFARVPKNFDIKLRRKR

SEQ ID NO: 20215 - protein, 404 aa, Candida albicans
VHSWDLFYKNMSDYLAQSLIQLPLLVLQQEQQSLLSSITGQIDTARNEAKVLYTEILSVKRRTQDATIQAISQNVSQIPKNSCNLTLYNTLRGHQNKIAKLCWSSDSSKILSASQDGFMIIWDAVTGFKKHVIQLSNPWVLTCSYSPNEKLVASAGLDNNCTIYKIKPDTSNFPVTEERNGTYQMQGNFYQSIQSIFKGHTAYISECEFIGNNSIVTASGDMTCALWDLTKGTKSRDFVEHSGDVLCLSTFPQNILSANLFVSGSSDGSAKIWDLRSPTPTQSFGISNSDVNSVKVFPDGNAFATGSDDGLIRLFDLRCDCELGHYSLSLELRNKQNLLHLTIPSPADERYMKRFGNTTAQTYDEQLTSLLHSNGSSSGNIDQYSVNSLQSVIENQGVFSLGFR

SEQ ID NO: 20216 - protein, 100 aa, Candida albicans
  UNSURE (97): Identity of amino acid sequences at the above locations are unknown.
LHCYIVMEVVVATLISIVSTACNQLLKIKVCFLLDFGKSGRFLYSCYSEYGCVVWDTLKSEIVGIMGSEHLNKINQVSVSPDGVALATGSWDATIKXWSV

SEQ ID NO: 20217 - protein, 289 aa, Candida albicans
  UNSURE (251),(262): Identity of amino acid sequences at the above locations are unknown.
ELGSFQRRGEEQTMMNYFERNGADPCPKEANPAEWMLEVVGAAPGSHAKQDYFDVWRNSNEYQVVKDEISRMEIELSKLSPLPLSSNGRDEKESRLTYACPLWKQYLLVTWRTIVEDWRTPGYIYSKLFLVVSSSLFNGFSFFKADKTIQGLQNQMFAIFMSFIPFNTLLQQMLPFYVKQRDLFEVRESPARTFSWFAFIAAQITSEIPFQIVLGTIAYFCWYYPVGLYVNAEPTNQVVSRGVLTWLLQVXIYVYVSTMGHXCYSVLEATDAAANLANLMFSICLKFCG

SEQ ID NO: 20218 - protein, 483 aa, Candida albicans
HLQFGLVLMIYPLMQAIGEMCSYLPIKGSFFHFSARYVDPALGFASSLIYTYTALMFVCIEATACAGLISFWTDINPGVFITIALVLFFLLNLFGAQFYGEFESIFSSFKVILILGLMLFSLISMCGGNPQHNAYGFQHWKEGGLFRPYLVGGTTGKFLGTYNCLIWAGFAAGGPDVLALIAAEVKMPRKNIGIVAKRSYIRIYLFYLGGIFFLNCLIASNDPSLVKSLKSSTVSPWTLGIQNVGVRGLGLVVNGAVLTSAFSCGNAFFFLGTRSLYSASLAGYVPRFFSKCLKSGVPINCVIFTGVVSLISYLNVSQSTGVVFNWFVNLATTGLLCSYICMWLAYFKFRKAYVVQTGKQMKKGEYPYYLAPKFIHPYFTYFGFFINVVVLFFNGFWIFFPGQFSVSNLFTSYFAPVFFICLFVFWKVFKKTHWRNAMEADITTGKQYIDEEEERDIEFELNRERRKGWFFVACRKASDFCFS

SEQ ID NO: 20219 - protein, 395 aa, Candida albicans
  UNSURE (34): Identity of amino acid sequences at the above locations are unknown.
RVLYVSFVMVIVFGITKYSDNDSISGASVGAFTXGRFYDIDKVGESITHFIDPKEMKEHLEYFSSIPHITGTKGDLALAKYVQSFFKNNGLHHVELNELESFTNYPDKTKTYLKVEDFEATLFEQHNEGMEFLAFNPNSLNTETPIKGSFIYVNYGEAEDYDKVIANGVEVKDKIVLVKYGGKTPEPNKVYIAEQHKAKAVVFITKKYSVSDDVIQRENVGLTRMSPGDILTPGWASENMYVTRLTWDKSETTPKIPTIPVSWKDGEILLRKLAGGVDFDGYKSGDGKSPAVELSVQNIDRPMHQVWNVAGSIEGREQNEKGVIIGAARDSGCYGTMGSNTGTVALLEMVKIFTSMQRKYLWTPSRSIFFVSFDATEYNLAGAAEWIENRKESLL

SEQ ID NO: 20220 - protein, 60 aa, Candida albicans
RIWSFGVFCVMGGAYYLMSTSEAFDNFCNGRKPQQHTDKRSLEDFLVSMQRVSTQHEKST

SEQ ID NO: 20221 - protein, 254 aa, Candida albicans
PYIMEFLKRHEGHMHMSDSATSMVTSATSAVMDMASATMSMTMSSYTSSSSGMAMEGMDHVSSHMAMNMWLTASFKDYPVVFKDLRASTKAQAFGIFVLLFFVAFLARMLEFVRNYLEEIVWKNNNYAEVEQGISQHSANLQSPPVKSCCDDNAKEVVSDESIDKQNSPQHEETTKARGTGKSLSLASTISRDIIRLALCIIPDLFAYSLMLAAMTYTLTYFFAVVIGSGVGRFVAERLMEHYRIKRGPPRNCC

SEQ ID NO: 20222 - protein, 439 aa, Candida albicans
EKFISEDNDKRSSSEDSEIREIDLNDSRQDLLGEANRSFSLKDKYQMDLHHRNYIPLRSQANDPDNLDETTPAPKQMLEAKNTFFKPAPHTFEKLNLKRAFFRSSWQRIDFISMVCFWISLFLSINHYDADHHIMLFRALSCLRILRLCNLTTGTTTILTACKIAIPQLIDVSIFIACFWLFFGIIGVQTFKSSLTRHCVWTNPDDPSDTYVNSGLYCGSYIGLNGEPAAYLMRDGLSSNVIKGYRCPMYSQCISGDNPYNGTLNFDNILQSLEIVFVIMSANTFTDIMYYTMDTDNMAACLFFIGCIFVMTVWLINVFIAIIVASFNITRMEVAEEKKKKREGRRIFKIFGYADQDVQMHEERLEFLKNQNVFLKWYYNLEFFFVICVIIDLFVQCFRRADMSDRRAHLLYRFEASFTGSFWLKLFCVLCPPRPGWSR

SEQ ID NO: 20223 - protein, 386 aa, Candida albicans
  UNSURE (375),(376): Identity of amino acid sequences at the above locations are unknown.
SRRLAKTSWNVIDFVVLLSLWIETIAYMKNDGKLSRIVRGLKALRALRLLTVSDTAKANFHNTMIAGFWKIINAAVISLCLLLPFSIWGLNIFNGRLGYCVDGLSDMSSCYNEYQNTVFNWQVVTPNVYTNPQLEFNRFASSFATLFEIVSLEGWVDLLNNVMASTGVGTPKDTNATPFHGFFVVLFNFITIVFILTLFVSVIISNYSRSIGRAYMTTDQISWYRVKKILVQVKPSKRKNIENLHFIRRFCYRMTVERNPVWTRTLNCVLVLHVIALLLECFPSYDSLNQFRTLIYMIASSMFFVNSIMLFTGQGFSTFMQYKWNIFNLVVSLGAFGTTTGSYFLDPNSPLININKLFLVAILVFVIPRSHRVRXXLTTSCRYPSF

SEQ ID NO: 20224 - protein, 268 aa, Candida albicans
GMQQYATTTSSRSFGSIFLIGWFMLSNMIILNIFIAVIAKTLEVSEEAKRKQQLLQFIDTMTNKLQDIEQDSGLLSKIKKKLFRRKQVKDELEEAVVNLLLSGTAVNDFLENDARNEVDDEEEAIRTLPASTWKRWLGVNYWRTLNLFRNNPFYGNKAKGRKVSLENFNPANFARTIVKERKNIVSKQNEFLEANPRYNYVFYVIGPHHPLRRLCQKMVKPSYGERIDGVAPYKPIAEAMVVWMSIATVPLIGIACYMKPNLPYWNMA

SEQ ID NO: 20225 - protein, 232 aa, Candida albicans
FYQEFYWQLPLYTSFDTSNCFNLIDYLDRRLLIQKVMKRLHTKRVYETIATYVCRWKFKKDNRLGIKDTNLAFDKKLARNSYLRNDQLLINKNPPTIFVTDEGGKRNLSDINVRDSSSLSTERNSVIYGEHSMSSGVYYPSTPVAKLNHSQHVKHSHPKLFIEIPSQKPQREFVTTEDEVKVSPFMDPEEVNEYESKNSGSLVDVGSIEEILELSSWKNAFDELKSDEKRKK

SEQ ID NO: 20226 - protein, 124 aa, Candida albicans
  UNSURE (3),(7): Identity of amino acid sequences at the above locations are unknown.
IAXTNGXGGGASKARGVFLEAFGTCILCLTVLMMAVEKSRATFMAPFVIGISLFLGHLICVYYTGAGLNPARSFGPCVAARSFPVYHWIYWVGPILGSVIAFAIWKIFKILKYETCNPGQDSDA

SEQ ID NO: 20227 - protein, 377 aa, Candida albicans
SSVSLFRVGLNVKILTNFFSRPLKDENIHSIQITGNFDNWSRSLPTIKSTKEYLQEIKLESRQDVVFKFIINDDQWIVNDQFKVTHDEHGNSNNIIYADELVEEFDNENKANTGATSESKDKENAPESSLSETTVALKPEAKSASKPIALKNDNDANDLPEPTIQKEQPKSTELHESLEAIGIEDHESFVEPVVSLKSPSKSIITEDDIISDIDSHGDNVPKKSGDLPQPSSTQQTLNQVLTPSSSFAAVSSPPVSSDYEHLDTKHEDQETEYNTAANSGVSTDTQGNEIVSTFQENKPVKPVLLPHDSESTLERTGSETNTNNNNSPRIPGHYPSSPEHKSSSTASLQSGNNAGENDSQYTGKRESLISRLRNLFR

SEQ ID NO: 20228 - protein, 412 aa, Candida albicans
  UNSURE (402): Identity of amino acid sequences at the above locations are unknown.
RILLFRPKGPEDVIVTGTFDNWSKSLPLVKQTDGSFSLQVPLPPKAEDVIYKYVVDGEWRINSDENITKDESGIENNIISKDHLKELIAVPGSLIPESGLPVTTPTAQPVSDNQDTLKTTVLPKEEPHHPSLAGEPGIVIPKEKDALSAFEKVEDADAKALNKNVTEVGTANAEAQTGSDNQDTLKTTVLPKEEPHHPSLAGEPGIVIPKEKDALSAFEKVEDADAKALNKNVTEVGTANAEPDSLVAVPSTGVLVEGSELTPEERKKQKKKVKKSQYKARKKQRAAEAAAGEANSTSDIDTEEATPEPTTQAEENNHSKAAAVGLAAAGTGGAAAATIAATTALADHPDTLGSTTNGGHITSKDPVQPPIYEPQTSIEKPKDSVTEPKLDSKFKTRAYQIXSEERSRSVSG

SEQ ID NO: 20229 - protein, 556 aa, Candida albicans
TPAVKTRANECRERFEALDSLNDHDAPAFHYGTHYSSAMIVTSFLIRLKPYVQSYLLLQGGKFDHADRLFNSIERAWLSASRDNTTDVRELTPEFYYLPEFLVNENNFEFGKLQNGESSHDVKLPPWAKGDPKIFIAKNREALESSYVSANLHLWIDLIFGYKQSGEEAVKALNVFHHLSYSGAINLDNINDEVQKRAVIGMINNFGQTPCKLFNRPHPLRDVLNLPNYYLTQFDGNASRLKLVFESKLKAPISKLEISSKNANRWVGRQNCISCEDDLLIRKAKKLKHECGSLLVNDTLFLSVHSSDITTVLQLGHKLFVTGAEDGSIYVWKCNLRPTTTLQYEALLRGHLTSILKIVYTKSFKFGASIDKDGIVIIWDFIRFKYVRKLFPPVLTEENTTVNPLLAVSNESGNFATVHFNKHLNGQLQLFTINGELIISFEFPAVDGQTIEAITFATTNSIMVDNTRTNNVNKHIYWSKEILAVARKKSIELWELIPENGWELKQLDKVDLQDRISGDITVIELFKCSEVDTEDKLIRGNLKLVIGDSTGKVYTL

SEQ ID NO: 20230 - protein, 990 aa, Candida albicans
VNTFVYRLDVNGMSSLNTKEIKEIELINLLYKNFPTLRLNQELIINWQVELLDKTSEFSSLSSIVSDNIVLDIDAIDLENEPNIIEILSYLEQDLTVNNNKDDEEEEEEDNDEFKVIILEILIFIISSSVRLRILLHNTLEYLIDSFLKKLSFGGGVTLENIRQPSIISQYMRLIILYMEFGCDTRHFKKLINPLIQKNNPLANLILSEMLLQIFTKYHAQFPVVSITKRINFPFSNDNLKKNFTIHSWFKVNRQLHNFSEDPMTLFTISSSGPVNGNGNEHNGATLKIKLINYTQFMVEIKNNVNGSKIRYTFNHILQETEKNQGFIHFVLTYDNYTNLNLFIDGEYNESIPCPDLHKYLSNWNKISIGEKSDDIALRNNEIILRNLTILNNNLSYEWINLLYNLGLGFDWEVKDFANDTTLHLLTQLNHQGLFNVALKFNEIKEQKKNIGVNNNNNNSNNMLFGSSTDTTNNRNALATFGGTRFKERSFQNIHFNMTHKLVNKEKIANSLAKIKGDHVTFDSNDFFQNLLYQGKKNVKQNVTSSVIFSNQRSIYQAFNVIGGSSVVLRILETSLEITNSKLRDSIVYTVLSLLLTLLSNNWRLEKEFESFNGYGILSVLLTKYKDFSNQLKFDKVLDDHEPETNLLNVLLEFSGHDFEYPYESAVVNPISYRILVLNFDLHYGTESFDYLLFQIHLLLYTSRHKEYNYNELRKMKILRKLVQFLKELKIDDYNMSQTFKEQLAQTLTGILHLDSSVETIVLLSSYIIFALYNNDSSTMCGTITLQVLTDYLCDSTTSIKTLKKFSRSITVHWILLLFRFQESEVVVNCGIRLLTKLLKVLGIHIIRKFFQLNHGLDVLTLFLKDWWDNETVLCSMFLASFGIDTQDTNNSELSQNNDLTEVLNSNINNLQQLIVPEFLLLLNNLVLNSMYTLSLKSGKLLHSNPSTPIKSNNQENVTLALDVLHLINQYITSIKIGFEKSKLLQKFYL

SEQ ID NO: 20231 - protein, 377 aa, Candida albicans
IKYHPRIVSFIRRHETLEQFLRLPPEQILLRWFNYHLKNAGSQRRVTNFSKDVSDGENYTVLLHQLQPEYCDLSPLKTSDLLTRAEQVLTNADKIGCRKYLTPNSLVSGNPKLNLAFVAHLFNTHPGLQPIEEHENIEIEEFDAEGEREARVFTLWLNSLDVDPPVVSLFEDLKDGLVLLQAYDKVLPGSVSWKHVNKKNNGEVSRFKALENTNYGVEIGKANGFSLVGIEGSDIVDGNKLLTLGLVWQLMRRNIVNTLADLGKGGHNLSDADILKWANQQVSKGGKSSNVRSFSDSSLSNGVFLLDVLNGLKPGYVDYDLVYTGNSDEEKYANAKLAISIARKLGALIWLVPEDINEVRSRLILSFVGSLMAVSEK

SEQ ID NO: 20232 - protein, 184 aa, Candida albicans
SFPPFFQGGAPTNISSGGYKSSSAAPPPPSSTISGNSATSPSVVSPKFKKPPPPIPTANSKNKTFLGGKTSGTTHTINDEERTEFTRHINSVLAGDPEIGDRLPFDTETFQIFDECRDGLVLSKLINDSVPDTIDTRVLNLPKPKKTLNNFQMSENANIVINSAKAIGCVVVNVHSQDIIDGKE

SEQ ID NO: 20233 - protein, 440 aa, Candida albicans
RGSVSPGPKKMDIVAHLKGFDEERRQLTLHKTLIDECLDINALRKLAEFAADFEQTCCAEGVSFEGERNKHLHDDLIILLARDDLHINDKMRLVLIYAFYRGGLIRADFEKLIRFIGVNDKYITGLVEKCFNNVEKLGFQIFKKNVKDKPFHKEMYHVINNEGTYNTSRFTPGIKRIMQNAGKYSLDREWFPYFRDQPLDEDIPTNNTRISSTTSTSTRTTNSAGKDLHTSGSLRNPRIKAAWASSSSTLSSSRNINTLGSQAKNKQRIFCFVAGGMTYSEIRSIYELSSSMNKDFYIGSESILKPRDFLIGLQSIDKNKTPENLDLNIYQELNKPTDPPLHVFEDGIPKPKKIINQPQNQFQQQIQQQQLMYQNTHPNANNGGNEQSSPSSSSSSAPPSHYQKRQTPGGNLDNIGNIGSPTSTVDSKEKKKSRLKKFFK

SEQ ID NO: 20234 - protein, 972 aa, Candida albicans
PINQYIEHSIQPNPINIMFDLNASDEELKSKYGLRNMHPTDIGDVTYFDTPIPEDLSDLTPQQQYELLIKLVDLNQPSPSQAGDANILLDLIIKQDTSKSQAIRDSKKSLSQFEHQVHKYNEDLKKIIESNSIHFINTKWKIDNAMIDFMKLKTKAQQDRASSRVFNPQRRNLTNKEGLTAELEDNINSLQANTSSMIQPIIESKAKEDKVVKMIEFTKANQNFFDLPNSLVHSLSLNNNEKFIDDYNRYIHDKDRFLSVLNNRYRDQVLKLTHDNINGKNDQALRTIEDDRKLQLTLILKVFKEIDTIAHNYRNKIYQEFLSLDHEASKTQSTSKFMSLVDNLSRLNLDDKMKNPIADFLTKQIEAIDKDFEYQVEKFDSKFLLMQNKLIDYIGSLNPERREGSHINYINEKYDTYKDEINSATINGENKLMIIKEAFESNDSLDLSLINEAWLVLFNFINYLDNMVLSNLLKFLNNYVHYIKLGIDSQGKIRDSAIELINKVVVIMMALFDDEDNNNNNNNNNKEKNNSNPLESSPKNYKQFVPYYTNSLSTIYHLTKINRIVNKIINNFGNFVGTIGNISQYSETNKVMKSLKNSSTKINQKILEAICATWVNDCSQFYELEDWTLDKQNNKHNNNNNKNKNNNNNSGNAKCTKLMNVIQCYQLYVLLKISNLVIHDQSSDYNVVAVYPSKRMLVSIEIQFMRSLNIIVDSMMKKYNLDRQISQQSSNNMDDSNAKNLQVFKILTMNNFDKLSRIIYPELLLQFDKFFDKDLLKQNLKLFADIDKASLTIIDDILNIEKLYIAQTVNKFFHTTTGAKAKAKGTNISYTSPQVLKVDGFVYEILIHFVKLINKIKPLTNEEVFVTIINELQLNLLKNILDNTRQILLKLSLAYVNLKLDANFILLVFEKSKLLQLNDSSYKILQILLNEIDNKNNELFNDKNQQFNYSKKDFDEILQLNMQDSANEFSCF

SEQ ID NO: 20235 - protein, 531 aa, Candida albicans
QVLPNMRVKKPTSKRTTTRMREGIKKKAAAKRRKDKKIAKKDVTWKSRKSKDPGIPASFPYKDKIITELEEGRRIEKERREQLKLQKQQERQEALARGEIVEDDDEMDEDDQEEGDGANGLAALLESAQQAAKDYDGEDYEDNENEDMVDSEEDVEYEISDIEDTQDEEFGELEKSRKAYDKIFKTVVDEADVILYVLDARDPESTRSRKVEQAVLQNPGKRLILVLNKVDLIPTHALNQWLNFLKSSFPTVPVKAAPGATNSTSFNKNLTNSMTSDALLKALKSYASKSNLKRSIIVGVIGYPNVGKSSIINALTNRHGNNSKACPVGNQAGVTTSLREVKIDNKLKVLDSPGIVFLDEIVNTKKQSKTQQLAKLALLSAIPPKQIVDPIPAITMLLKKFSKDTEMADGLKNFYQLPPLPSSDLNEFVKHFLIHIARSKGRLGRGGVPNLESAAMSVLNDWRDGRIIGWTLPKASKSAAGVSSEQIDLDAPKSSLRGEKEPPKVEQTTIVSTWAKEFDLDGLLGDNFGLQ

SEQ ID NO: 20236 - protein, 335 aa, Candida albicans
DLINSQPGKEKYSRIDSKPWMFLWFSRIFNRSYPSLRPVPRERHIDDAEKDSKRLAGYIPANQIPEMVIVSPSCISVKSFNGPNFYNIYCDGRGVYYCQCPFNSFSMDYCKHIYLYKRYQKLKEEGAIIVQQPSIATNIHLNATPLVEGRSDPANSVQNSIPRPLTGNVESGASLLADDENDVVFVKERTIPESSKSEESEIIQGVYSEKVARNIQQWEENNNSLDAEVKKSEDRLKIQREKYEKQIKYALKQMELARKEEREYQLQFAENHKIRKKRDTARIKTKEHKQTLEKIRKIEEMIRSNNCNEIDKKAKIHEIKQLYNSTAPDPVTASS

SEQ ID NO: 20237 - protein, 656 aa, Candida albicans
ITHIGVMEYSHYPSALPPSNTNFGTVKHRILVLCKKNSGRMQLQKGKYQADKNFYQIGRTWDLSELQYIKKVGPEGLILQLNKVYYWKCDEDANRVWKFARYLTQHYGMFMGKYPRLEGFSLDDFMLPTIPKSPTTTVPRSPSLNEPNPDPQLLKSRSLKRKNMPNPVLPQPPTAPATKTPPMPSKPEELYKDMDFTVNGALPQKQMKVILRESNDRGFASKLDPGRSVHEQQKPQGSHLQLGFNSPSQDGTHQAPPPKKHSQHPYFQRSPMNGTDSSSVVSNDSHSFVFGSNDDKNQSRERLDNSSRSSRQQQGSIGTGSQSTNTKGLQTNSYASKKQERESVASQKSAEDVVKEFSEAIPPKRKMAASATVPDFGVEEITDDSEDDQRPAPTFSIRKRQQQIKAQDKKNEETQKVTNEQPIRHHHEDATTSFADKSSHYDEKTFASQKGLGIYPAGSGSFIEESTKLEGQNSASSNLQDLQDLLSSHIDRAQEDSFDFNDVSNEKSADDLNEIPEIRVAGPSNNLNGDTNSFEGEPLEKGLNIVRKSETPENEKVNPSSIIPKDQRDVEVDTLINQIGWSVKDTTDTLMKKLSKELNNSKQDIVSKLVSIDLTNNSGNDIGSALNEVDNMTQIFQKMEVRLKLVRNELQSSATA

SEQ ID NO: 20238 - protein, 423 aa, Candida albicans
LFFSRQKKNIHFTLYPTMDENYDVIVLGTGLTECVLSGILSVEGKKVLHIDRQDFYGGESASLNLSQLYGKFKPSSQKPELKGRDRDWCVDLIPKFLMANGELTNILVNTDVTRYMEFKQIAASYVYRNGRIAKVPSNAKEALASSLMGIFEKRRMKRFLEFIQNYDEADASTHQGFDLDKNTMNEIYTYFGLENGTKDFIGHAMALWSTDDYLNEVARPTYERIMLYASSVAKYGKSPYIYPLYGLGELPQGFARLSAIYGGTYMLDTPIDEVLYEGEGPDKKFAGVVTIEGTARAPIVIADPTYFPENVIKTGAKVITAICILDHPVPGVELDSLQLIIPQNQVGRKHDIYVAVLSDIHCVLPKGYYLAIVSPIIETDAPHVELEPAFQLLGPRLDPLMGIARLYDPFDDRTQKRDLPPPR

SEQ ID NO: 20239 - protein, 79 aa, Candida albicans
  UNSURE (29): Identity of amino acid sequences at the above locations are unknown.
PAFKLLGPRVDTLMGIAELYEPIDDGTKXGIYFSKSYDASSHFESTTDDVKDIYFRITGKPVELKKRPTAEEEEALQGL

SEQ ID NO: 20240 - protein, 170 aa, Candida albicans
  UNSURE (7),(135): Identity of amino acid sequences at the above locations are unknown.
RIYTTPXERLDSIKGSIGEVHQVHDSTIGEVREYDTIKKMTMVNQFLHQVGSLYEDISGFKRFVEALNEEIQRELQGLQNDLKYPLPNFVRIHHAYTHARNFVDYLEVYSTRLSDDLQSIVYKVVSPIKTTINLXDELLNERIQSLTEVTNEGNFECFFNILGVVTWERE

SEQ ID NO: 20241 - protein, 383 aa, Candida albicans
RLYYNRLHDFTMDLINTDPPAEDLLKILLYDSKYGAFVSEFGVKQKSIIGEELKNSVLDDYLNNITTKMKEWNDNLIRQETKTFTERPNAPDIYPIELTIEDLDADKNEVQLTIDLNVYVMPDFKIALTMLKEQADVAAESKYSRILVEVIESWSECYVKRIANFREVVEDEMDRYMSVFNNEGYLIKESKAKRLFRKKPPVVDIDSLSPEEQSKLLREGLIEYLAALANSLDISDDIMNDKFAPTYKEKVHTNYHARIGKAFDVASESSNALISEILSAITDIIMNDLTPALCKLFTKKWYEDGHSQTGEPTLGKLVVETISEYLGEMRQYCVYPVYHLLVCYFFGDILFLRILEMGYEKYLAWAMGKKNGSPGPPKNYKSV

SEQ ID NO: 20242 - protein, 612 aa, Candida albicans
LTTRKHEVENGLKLLQEVSENASKINDLENLLNNSIENSPGGIKLYLINLNQLKNLLSQIKTQSKFKQFKGILYNFENLIDRSETKVQKYYQDLINGKDSRAIIDKRDEIKLIFQYFSNPQTKSTSNSGGNEEYVTKLYVRARSKRLIEKLKPIESSTKPAVKANANIPYEKGTNGITKYTDVLSGEIEQELIILNECQLSTHLIGPIVEESILRYNGIINKYNQVYFKTPQEIVDNVILILEVLNNLIDFKVKLKQIGLNRTLEQSNFINTFEQYLETNSVIFKEFIQAIDNRFQNLGKFNEINTQEVIVELMSKLRRLSEFKLALLQLIKNYSIGQWLVSQPPMRFVNVFSSVIPNSQPQANSDGEEDEVIQEYLLSSFYSDVIDAIMINIEIGLKKNTSGGDSLPLSSSTSASTNATSGTSSLSLNKKSTQGFILIKNLFMLESIVNRSQYLYQSLGSVGEDRILRLKNRFLEIISLDDWSHASYIIIRDMTTIATQLAQHQQSQQQLSNTIGTGGGTVTNLSNKEKDQVKDLFKNFNESFEEALFNYQKYNFGDAILKKYLSNEIKKLILNTYFKLYDKYGNSDFTKNKSKYVKYDKLNFEKLLNERL

SEQ ID NO: 20243 - protein, 522 aa, Candida albicans
GKSCRHKPNQTNPISSPYTIMLKENEIISRALVTIDNFKGSLKAFKSSITDGGYTQLHMPNCFSRTLVWKVCLITDSFKISTWESKLNDSIVVFDQLIIRYDMKLPWNKLDLDSVFYHSGDLSIKSSITRKLSSRDSKGLHKVSLLRVNTTEDPLSSSAQLLGYVNTGDDLELLQTIILDIDRLFPGEDFFSESNKYSIHRKKQLIEILYLWSKCNPQVGYKQGLHEILGLIYMNLSQESVDISQTNTFSSDDMKILSLYNVHYLCHDVFTIFNKFMLQSGNITHFYASEDALWKSIENFNVYLMKIDQFIHYTLNTKLNLEPQLWIIRYLRLLLLRELGSDLETTMLLWDKLVSLQLPINLGNSISSIPDILNFMIIQLLIQVKTDILSSDFSECLSILLHYPFKPTTQIEKHEFVKKLFKDAVKLYEKRNDDLKLYEYGIRLNNRYNPNLKILMNYTNGERSSTESVNSSRAASPAPGSNPPPTSAPPSLSSSRNDNMKFEKMRLEMRLKKKAQLMINPK

SEQ ID NO: 20244 - protein, 583 aa, Candida albicans
QKMVLTHSTATDGTHIFYNKVSGNYLILTLGGGVEVSQTIPFVYQNLANAKTISCIIGVIRLKFNSYVIIADKHSVTGSILGHDIGFIESFQILPIGINDLAKKNLEELSYLKLLTTHLNNATLYYSIDNKYDVTNSLQRQFNKSNTDGVVPVDDRFWWNKYLTQDLVNNHVGNDFVHPIIYGYFKSHSAVFNGKSLQFALLTRRSTLRAGTRYFRRGIDIDGNVANFNETEQIFISDDNHLFSLLQTRGSVPVYWAEINNLKYKPNLVISSQSSLDATEKHFHQQVSLYGDNYLVNLVNQKGYEKPVKQAYESAVNNLPEKLGQHVNYIYFDFHHECKGMKYHKINLLLDRLISLGYTLNNYFEYDLNANKIIRLQDKIVRTNCMDCLDRTNVVQSTIGRWVLQNQLTETNYLSSNNVTPFEKLNPQFNLFFQNFWADNADAVSCAYSGTGALKTDFTRLGKRTYKGGLNDFLNSVTRYYKNNLTDGSRQDSYDLFLGKYKPFQDSVRSPFIDRRSPYNQLLPYLMGTSFLILLAIIYFPKGSIWDWKNLFIMAFCILFNLKNLSYINSPGHQFVDYETRPG

SEQ ID NO: 20245 - protein, 794 aa, Candida albicans
PHIPTCPPRMSFSIYELDENIKKLLTVDNYLNGLSVNDFIEEISKDHFLKGAEVNNKAYLDPKPYIRTFESTLRELKQLQAEANEQRVKNERQVDSYELKHSENVLELNQQIDEATKKFDILDTQILDVSTRINPLGNTLNKITNSRDRSLETIFLIRAYHGFFMKEQYLPLETLKNSKKLDDKLKCAKTVRNLLNLAKKVSDEKLPKSMKCITTIEQFGETMEKELLRKFEIASEDEDDIDFDMMNQIAQILFEYNEGINVIQTFVIKNDIVIENEEKSLDEQEWALLADSRRSDFKIDEQATFDTLKFEIKSRARISKKVFADPTPVIKIFIQRMYAQIIRNKVTSLLQKSLSVSPLAHVRVLHSLYTLVGDFTEQIKDYLTTEELDKDQELSAILDQSHSDLFVEYIGDNVYFNREKKNLEETIYGIIHQFNTANENIIANKSLAARLENLDNVQKPEKDRFSFASEKKRMNQFKQYVNAKFKDRTRNSEREPTFMECKSLNVGNVEIVLKSVIESVARLLELVPTKSADYALEVLEILIIDFGKLYIGAGLEVVYDECKKNASLDNLSSFNTISELLFLMSSCIKRIILPIATNIPSIKTRMSNMVNGFVAQCEISLNVILNDTLDHFRVKLQSQLAKPKKRDFNCNNIEDDTEACELVSNYLVEIHSSIVSAMNGANLEKILIKIGMEVLHQLLEHYKKFTVNSIGGIVLTKDVIRYQSVIDGWKIPELSEQFQILREIGNLFTVQTDLVNSLVTEGQLANMKPYTVRQYITKRADFNPSYADKFFKFK

SEQ ID NO: 20246 - protein, 129 aa, Candida albicans
FNSDTISTTMKLSSVTPLLLTLLLFTTAHGGHGHEQESLKIKPQDLSWQDWHMKEEHGLEEYDGKTFFILHDLNNNGILESKEILNLYGLVHKIIIGDGSGMGQDKIEVTPELQKQVVENIFQLIPHGN

SEQ ID NO: 20247 - protein, 94 aa, Candida albicans
RQNGGRLPDLGYGPGHHLGFEEEYEEHHWRKYHANDDPDVKIKHKEDIEHELLHHQQEIEETHDRSSRLKKFAGDYWSEINIDNLKPKYRKQQK

SEQ ID NO: 20248 - protein, 191 aa, Candida albicans
SRADLPFRGQYESVTSANASIRQICTNAIGMAAQYGGDGYAEFCLSLLEPMFKMAMVPDARADENVYATENCVSAIAKVCHRFSSSVPNLDSLIDQWISLLPIVQDESAAPFAYMFLSELIDRNHPSVLKQVPKVVESVIQALAHASISGNTAQKVVISTRTLLGSIPHEEAVALLQKNPSDLDVVQKFFS

SEQ ID NO: 20249 - protein, 569 aa, Candida albicans
TKEYFKVMTVLPNEYHSALTQLLENLLSTDNTIRAEAEKSLDQNWTSKDNVELLLVFLAEQACQGNNDTIRAFASVMFRRMAIKSPKELQSVTDRTIGVIGEPARQQIRGILLAGFTSPQSNQVRHKLSDAISEVAKEDASPAGTWNELIPALFEATRNEDPSFRESAFRVFSASPELIDNSYIDEVLPVYNAGFEDANDDVRIAACTAFVAFFRKLPKNTWKLLSPLLPNLLNSLPRFLQNGQDHALASVLEALIDLVELAPKMFKDMFPTIIEFCSAVAKNKDLDLNSRMAALELLSTFAEVSPSMCKLTPTYTEQMVLITLSMLTEVCIDDDDAAEWNNKDDSEDEDEEQEYGAARQALDRVALKLNGQALAGPLFQYLPAMVLSSNWRERQAALMALSSAAEGCADVLMNEIPKILDMILPSLEDEHPRVQYAGCNALGQMSTDFADVIQRTSGDRILPALISKLTNKSVPRVQAHAAAALVNFSEAATKEVLEPYLDDLLNNLLILLQSPKRYVQEQVLTTIAIIADAAEKTWVEYYDTLMPLVIHVLRADVGCKKQIVESKMF

SEQ ID NO: 20250 - protein, 229 aa, Candida albicans
  UNSURE (228): Identity of amino acid sequences at the above locations are unknown.
ARSVYPRGDDFGERCLPYLPSVLPPLMLTAKASQDISLLEEEDAEELKLNEEWDVINISGKWIGVHTVTLDEKVTAMDLLRTYAVQLKEDFMPWVKEIAEEIAIPGLDFYLHDGVRGSAALTLASLLRCCVAATGNNSTEALTLWSKICNKLSELLCSEPVPELLIAYYTTLVESINVLAPNAVSGIQLQALSKAVNANMIEIYNRIKERDNAEDEFTEDLEEDEEDXS

SEQ ID NO: 20251 - protein, 307 aa, Candida albicans
  UNSURE (15): Identity of amino acid sequences at the above locations are unknown.
ICFWGIIFMNLINPXYGNYKMIMLFIMIIQVNGLHGPHKSYINWYNEAFLLDSRYSFSGNECNEVLRLEAFPDCNEKWFNECYIPRKYQSFTELFQFNMNSNSRYFPPTENTENGNKFDYSPFESRRKKYKTFEHESKAKLEIKTPRSKRIQKFLPFKNDHNNTSSLISSKRNLDLIEDNDEEDRSITPDPDQANSIVTVNEKDIELYNSQWDYDKIIKHQTINTQDYSFNPRVKTNIEDKEIYWYNSNEIFSKFRNGSDGDGDARREDLISPQDLKTYLTFDSIDNEMITNFNNQLDLNTDNNYFF

SEQ ID NO: 20252 - protein, 317 aa, Candida albicans
  UNSURE (301): Identity of amino acid sequences at the above locations are unknown.
CGQGNWNRTNCSGTCLLTSFHDPKYGLYNNPRYNSLVRHRGSIPLYWTPDMNEFPKPRIQINVDDPFYQGSALHFNDLFHRYGLPIIVLNLIKQKEKQPRELKLNHYFMACIKYLDQFLPEGKKIQYFSFDMSRHSKKNLDVIGPIQAIAANAMSQIGFFHNGINLSTTKLQKGIIRTNCIDCLDRTNAAQFIICKEALTHQLRSLKIISETQNLDYDSDLINVVTEIFHDHGDTIAIQYGGSNLVNTMDSYRRINQWSSHTRDMLNSIKRMYSNSFMDSIRQEAINLFLGNYIYEPDKPXLWELQNDYALHNDYSG

SEQ ID NO: 20253 - protein, 159 aa, Candida albicans
RERGNENEEQQDDYGDASESNKRIILQRFTIYNATSTMYIVGSYSKDSLFRIMEISKDEENDYVVSIIGDSNYFYTRKDMIELLNGLDEYIEGGIHKVAQGYGMLGLIRFTQSYYLCLITKCSQVAILGGHFIYHIDETKFIPLALFTTGEEQTGLIKG

SEQ ID NO: 20254 - protein, 259 aa, Candida albicans
KDQSLLLDNNNNLNGMNNTIKTHPVRVSSGNHNNFPFTLSSESTLQDFLNNNKFFVDSIKHNHGNQIFDLNGQGQSPHTLWIGCSDSRAGDQCLATLPGEIFVHRNIANIVNANDISSQGVIQFAIDVLKVKKIIVCGHTDCGGIWASLSKKKIGGVLDLWLNPVRHIRAANLKLLEEYNQDPKLKAKKLAELNVISSVTALKRHPSASVALKKNEIEVWGMLYDVATGYLSQVEIPQDEFEDLFHVHDEHDEEEYNPH

SEQ ID NO: 20255 - protein, 183 aa, Candida albicans
RISKTRSQSNHTSIMQHTSAGGGFFSKIKENYSSKLAGLSLAGGPYVEKDGSSEDNTLIHNAFVKYYDFKGLPYPDWLGVKTFQSQQQQQQQGYGRTQHQQDYSQSKYQPVRQDNTFNNSYNARQTQQQQQQQYQQQTNGSDRPNSGGYQRSSSRLQDLYNKSRQQSIPGQGYNTSNSWSHNR

SEQ ID NO: 20256 - protein, 524 aa, Candida albicans
KMYQHQDQTQHQYYQQYNSYNPSIEDLIASSDDKRYQNGGIGNLLQRPPVAGLPYISSQVNPNTSSANLSKLTNNINNYGYNNNNNSYIQLHTPPLSSNPSFTSFQNLNYPLSPLSKATSPEPILSAASVTTSNFLASSFFSWLPPIDVKIVSFCIGWYLCSIISSNSTKLILNDFKFPVTLTQFQFSASFTFCLVFLNIVKVNPESISSKLPPGFIPSMTDTNRISLSEFITPTRLIILTTLPMGMFQFIGHITSHKATSLIPVSIVHTIKSLSPIITVLIYRFLFGKSYRMRTYVTLIPLCCGIMLTCYKKSHTSNQNNVPGAGSSVINNNLDKINTNNNYSTGLIFAFISMIIFVSQNIFAKKRLTVESTNAIPMNNKSSLRINSNKVDKLTILFYCSIIGFILTCPIYFVTEWMNYNAFGAISLLQLNSYVMSLVLLNGLSHFVQSLLAFQILGMVSPINYSIANILKRIFIILISFIWELKQFSNSQSIGLVITLFGLYCYDRWGTVSNSGSASNPGKY

SEQ ID NO: 20257 - protein, 188 aa, Candida albicans
IMVSLYDVGTRCWYPDEKLGWISATVKSNKKNGNKHIIEFVPENDDSQVFTIETDNLSEENDKLPPLRNPPILEAAEDLTSLSYLNEPAVLQAIKLRYSQLNIYTYSGIVLIATNPFQRVEQLYSQDIIQAYAGKRRGELDPHLFAIAEEAYRCMKEDGENQTIVVSGESGAGKTVSAKYYMKIICYR

SEQ ID NO: 20258 - protein, 1260 aa, Candida albicans
RHTNQGGMPQIEGIDDAEEFRITNEALSLIGIDKSKQSEIYKILAALLHIGNIDIAATKNDAHLSSDEPNLTKACELLGIDAVSFAKWCVKKQITTRNEKITSNLNHKQALVARDSFAKYIYSALFDWLVDYVNSDLCPDEVAARVKSFIGVLDIYGFEHFEKNSFEQFCINYANEKLQQEFNQHVFKLEQEEYIKEQIEWSFIDFADNQPCIDVIENRLGILSLLDEESRLPAGNDESWIEKMFQNLDKEPTNKVFKKPRFGQTKFIVSHYALDVTYDIEGFIEKNRDTVGEGHLEVMKNTTNPLLQSILEIIDKNAAALEASKPETKAPRAKIANKKPTLGSMFKNSLIELMKTINSTNVHYIRCIKPNEQKKAWEFDTLMVLSQLRACGVLETIRISCAGFPSRWTYVEFADRYHILVPSQDWIRVMSGDTTQESVSGLCNQILTTNIENKEKYQLGNTKIFFKAGMLAHFEKLRSDKLFKSAVMIQKNMRKRFYRKRYLETRASHIQLQGLIRGYMSRKRVREEQERVAATLIQTSIRGYLARKQFAQTVLSVVTIQKSVRGLQARRNYLKLRELSSAVVIQKSWKAYQARSSYQTQRKSAVIIQSAFRRQYAIRELQQLKVEAKSLNKLKEVSYQLENKVIDLTQSLTAKIQDNKKLMEEIANLKALLEQQGQAHETLKTRELEFNEKFDSQNAEHQQEVENLNRELETIKNEYASAGAKIEQLYKEQAELKQEVQRNIEELNKAKDDLVKRDTIEVDLKSHIEQLKTELAKLQQQQSEARNGSAVLVNSKARNVNKRHSSAVAWNSPNSLDNSNRPVSVIAVSNDEDANIDDINDELFKLLRDSRQLHREIVDGLLKGLKIPPSGIAADLTRKEVLFPSRIIIIILSDMWRLGLTKESEDFLGEVLSSIQLIVSALKDDDVIPHGAFWLSNTHELYSFVSYAQHTIIANDNLAHEMSEEEFDEYLKLVAVVKEDFESLSYNIYNMWMKKMEKDLEKKAVSAVVLSQALPGFMAPESSPFLAKVFSGGVQYKMDDILSFFNTVYWAMKSYFIEMEVINEVIIELLRFVDALCFNDLIMRRNFLSWKRGLQLNNNVTRLEEWCKSHDIEEGSNYLSHLLQADKLLQLRKNTPDDISIIYEICFALKPIQIQKLISQYYVADYETPIAPNVLQAVADKVKESDSSNSDDLFELVSTDGHFNDPFRNIALRPFSRVEAYVPAWLNLPVIRRIVELVAKNASVQESQSTIGVEEEANGL

SEQ ID NO: 20259 - protein, 812 aa, Candida albicans
DDGLRPSCRKLISEGSKTAEKYNLWSLPAMNGIKTYLEEQSNKLFDMIIDELQNEIYLKYNRNPQEGAIAWQNIIHSSNPQLTSFVTLLDLKNLEQFIFNSANLDISEVVDFLTSPVKNFIVNQLPDLHAHNSKNDGVIDYKILLDSTLNPNTESFYYIYMLLLTASKLNRLNQAVEVLLDTNQLELHSLINRTTEAVKLRNGHALSKLSKMQHLDHGSLFDVIVHGSFSDSAVVLLQDLFGSIFIRCLATFQRHKVITQIVTLLQEGKALSTPKAVAESTPTFDSPQMGRPDTFHARNLFTIWKTIQKELKALMLNYIYDDHNYKLHSLADTTGATNRNKISNALGKKELFKFEDVTYNPSNKTTKEILDVLADVFPGYSISDDNNNGAIIETATPYVKHESFNATVEVLVPKNLFNMRIILEFFLIFIDGSQRIFFDFEDEKTRGVHARTSFHFFEDFMKISFLSYLRNTIEFNFGEQVGGAYSMKIEQAMPVNSGLKLDLISLSQDSNFKILGNAVSNVESNLIIYENAYNFKKMFLELCLILNTSLSYRENFSGAVLKTLENFSNEYNKLYQELLSTGEGTNIVRPPLRVSKWMKIPVLTEISGKILQRGVQGETANELQELIESESKVVLHDETVTHQEDLLDHEAYAQIVYLLLTTTWILSWLPLVKKESNYSIYDDEQNKTIKVSTVDKLRYNWSFLENGRQAINFTPDGTDIVQYNIYLALNSEKIGEFNNIIHNFESIRDKTLLALTYELRCKAVYFVTMSFKHIDWCPVTEPGDADHFIVNLNQEIFAMDNKLSKTVNELEQ

SEQ ID NO: 20260 - protein, 125 aa, Candida albicans
SLFLGFSPFLNDLIITRSKAVRKINSNGIKRILLNISTVQQMLRNLSSNPETIDFTKASEYFEMFTMNEFNLLKFIKSKRDNYTKDAYHTLARLIYSEKLADGNGSLFNKGKYNDLIKKIDGIFD

SEQ ID NO: 20261 - protein, 147 aa, Candida albicans
  UNSURE (27): Identity of amino acid sequences at the above locations are unknown.
LFPWLPPPLPNMTHKSIFAVFAAAFGXLTSSYYGFFAYFVAAFAGPVILFVFDFLNFVFTFAAATAIAAGIRAHSCSNQDYLDDNNIAQGSSGRCRKAQASTAFLYFSTFIFIASAIFSAISLSKGGLFGHSSRPAPRTGVPTMSQV

SEQ ID NO: 20262 - protein, 305 aa, Candida albicans
AFFYLFRRIFPIMPDRRSLIAEAEKLLKPQLGFFLFLSVSSASMRKEDATDLYIQAANLYRLKKDFNLAGAQFVKAAEIQESLGNHNDTANHLVEAYKCFKGVSPTDAISSLSKAIHIFLTQNGQFRRAANFTMDLAELYESVNDYENASKSYEQAGDYFTTDHAEALANKAFLKCADLYALNGNYKRAVELYDNIIKNLLGNSLSRWSLKDYFFKVVLCVLCMDDVIEAHKRKDQFLQDDPSWGQSREYKLVEGILESIDQGDVEGFSDKVFDFDQFSKLDKLKTQLLLKVKNSVVAKDDDDLL

SEQ ID NO: 20263 - protein, 163 aa, Candida albicans
RAWSFHRVVKTAPEKILEGHKKGVLSLNWCKQDPTLLLSSGKDNSTFLWNPIEGIKLGEYPTTANWAFETKFAPAAPDIFATASFDGKVVVQTIQDTSPSVSTKVASTDDNEFWSELSTTETQQPVFEVKQAPNWLKNPSNVSFGFGSKLVIINTDSSGKSTV

SEQ ID NO: 20264 - protein, 185 aa, Candida albicans
SSIVIYMGLTISKLFASLLGRREMRILMVGLDAAGKTTILYKLKLGEIVTTIPTIGFNVETVEYKNISFTVWDVGGQDKIRPLWRYYFQNTQGIIFVVDSNDRDRINEAREELQLMLNEDELKDAVLLVLANKQDLPNAMNAAEITEKMGLHSIRNRPWFIQATCATTGDGLYEGLEWLSNQVGK

SEQ ID NO: 20265 - protein, 106 aa, Candida albicans
LVMGLSFSKLFANLFGNKEMRILMVGLDAAGKTTILYKLKLGEIVTTIPTIGFNVETVEYKNISFTVWDVGGQDKIRPLWRYYFQNTQGIIFVVDSNDRDRIAESI

SEQ ID NO: 20266 - protein, 449 aa, Candida albicans
VNFNGLNELAEQILQEANISEKDVELPELGDVVPLPKPIGEPVGNWPLKDSELSYFETALITGKIENLSINEDNLTTGAEGFESGATNIDENLGFDNNNNDDDDDDGEGGAFGGEDDAEAWDLDDELDIGDDDIVDENVPEFVTTENEIGDWLRNAKTPATYVAAGGFEQAASLLNKQIGVVNFEPLRTRFNQVYGASKLYLPGMDELPAMKTYIRHDNDEDNPRKFKPVVPGYDKLEELLSLGFKKFKANNLEEAITTFRKVIYTITVLNVDDEDDETKCHEILRLCREYILGLSIELERRKLPSLDVKRNLELAAYFTRAQLQPSHKLNALQVAMTQSFKNKNYASASYFAEELLKISNNSGPRAEQAMKLKNKADTIANDTIEINFDPFAEFDICCGSFTPIYIGEPFIKEALVGATFKPEFKGKLCNIIDITAVGVPASGLRIKG

SEQ ID NO: 20267 - protein, 729 aa, Candida albicans
LSIMKMLTKFESKSSRAKGVAFHPKRPWALVSLHSSTIQLWDYRMGTLIDRFEDHVGPVRSVDFHPTQPLFVSGGDDYTIKVWSLNTRKCIFTLNGHLDYIRGVSFHHDLPWIISCSDDQTIRIWNWQNRQEIACLTGHNHYVMSAQFHPSEDLIVSASLDQTVRVWDISGLRKKHSAPTSSVRAFEDQLQRQQLPQQDIFGNINAVVKYVLEGHDKGVNYASFHPTLPLIVSAGDDRVVKLWRMSDTKAWEVDTCRGHTGNVLSAIFHPHQDLILSVSDDKTIRVWDLNKRVPVKQFRREHDRFWLIASHPTISLFAACHDSGIMVFKLERERPAHTIFQNKLYYVNGEKQIQTFDINKQENSLPMLSLKKIGKTWSFMRTLSYNQSDNSVLVVHGEGDNGNYALITLPKHVTGAIEPTDIRQGEANFAAFISRNRFVTFVKSTKTLQVKDLNNNITKTVQLDLSIVDVLPGSPGRILLVKAHSVINYDVQQRKELAEISVNNVKYVSWSSNGQYLALLSKHTITIADKDLKLITSMHETIRIKSAAWDDTGVLLYSTLNHIKYTLLNGDNGIIKTLENTLYITKVQGNLIYCLNRQGQVETITIDPTEYRFKRALVNKNFGEVLRLIKNSTLVGQNIIGYLQKKGFPEVALHFVQDPETRFELALECSNLQVALEQAKILNNNQIWEKLGEEALLQGNIEIVEYIYQQLHHFDKLSFSYLYKGDDER

SEQ ID NO: 20268 - protein, 68 aa, Candida albicans
LPQMSNEYELRDALLLLFANKQDLPNAMNAAEITEKLGLHSIRQRPWYIQTTCCPTGDCLYHSLEWLS

SEQ ID NO: 20269 - protein, 414 aa, Candida albicans
KFDLSTNPIHYISQLINIMITHTTRTRLINRILLLPKYNQFYRLNSSKNKSKFSSIENFNKNKTTYNFGYNFDDLKDLDDKINPQTTKTSSNGNNQKEAIKRGTDDNDKPIDINALIENDPRLLKLKPGTPEYRNELKKLHLEFESNQNKQRSRHEFNQRMKGMIFGLLALIGIVSTHQILFNYESIKNRLLSNYNYPDLNEEKVKTINDKNVKSTKYMLEKLSKELNDENLNQVQDSKTISGVYVFGDDFGKIPLRIPFFNNMYLKDAYIEKGHLIAITDKGKVYEWDKDWSDVRPINLPFNIERVTPTKDYFYFLTNKGEIVYIPRRRINSNSNSNSNSEFIPLQRRNWFGLLKTQIYNKLNVKDITKISSGDYHLLLLNKLGKIFVVNCSNNPINRGQYGPSFSPFADIKE

SEQ ID NO: 20270 - protein, 515 aa, Candida albicans
NKQFKESNKIEHIKVPVKFSYHPTLEAEAKKKKAAEAEAKKAKETKATVTSTEAKDAKEETETKAEKVEEKLETDAKEPLIEDETKEEAKVDTEAKEPLIEDEDKQEPANEAEEKEAELEDKAEEKLVTDQPKDEEIEVAEPKEVSAASEVEEQKLEKDAAEPEIQDGEALKGDDNIEKQIKENPIELVDQPSQFKYEPVELPNKETLDKLQDKPVLLKHYQELNAIGVGSIANRIEDPNKVIELGSGLRMTQQQLLDIAAKRVAPVITNINDEVSKTRQEDEIKRQQGLDNKVKKHESKLQSDFEKYLGKIGKKKDKFNKEIEEKLANFETMIKKSNNTAIEFEKTTKGEIETANKEYEEREAKAVEQHATDKETIEKNHEELLATKKQELEDAKTGQETATQEIEELKDKKTELDDKNSELADKIEQLTAQLNTELAKLDDLKANHKEHQDSIDANLTKKKELDDNLTIIRKDLSDKKEKHKGLLAEVGVLAGSAAAYAARLTSLHSDKEDRA

SEQ ID NO: 20271 - protein, 339 aa, Candida albicans
STIMGKNKKKQNNSSLKKATKEDVEQSKQTIDNVNKDEEIQETEPSEDTTSNESEEESTKSQKIDQTGQTEQLDPSATSSTELLEKLQQTERERDEIQQSYDNLVNKISSMKTIFSKMKQSEAELEEKTELVESLTSENEELKRQLQDAAKSKVDSDTITKLQEQNTDLNNECERLSDSLTKSRREYNSTLQALQDENYNLENQNSKLSKKVQELNLEINDLKITLNELTMDQKDYTNAIEELTDKLALKTDEVTEATKTIEDFQALVSLKQSNFDKETTSLKSTITQLEEKIAKQEKENEDVNQSLDKSQQELLELKEEVKKIDELKSLIHNKQLSIG

SEQ ID NO: 20272 - protein, 844 aa, Candida albicans
GTTYTIPMIEVLITVVPAVLWLLYRFFLVLQTPVEKLIEDLNIEIPHTPILCIDSISERSIVIHWDIEIKFDENLYYVIVVNEQEAATLTSTSCRLNNLTPHQLYQIEIIAVNSITNFKSQSKPVFVHTSNDKELDGIVNVDHLETEIKEIEPISGTLDQSALETITIDQIKNIKDSNLLNDYIVKFQNELAKTNTEYKQFQSSISQEHETLQRDLSHHKREFEEESDNKLKKDHDLKSLERKKDNLSFQKSKLTTQLNALKNTLSLFNTKFEENENKIKKLREKNTHALNTEDQEKTKIKQEVDSIKQKISNTKSDIEKTEENMKLIALERKELISILNQLKPLIDAFNQAGSSNTQSDNNGVSQLLPSSLSSTTTANTTSVSNTSTTATATNNTATSVFNRDGSLSKNAFDAIVKIIQIVPSWQDEIMHEINQYQEFEQNWKEAFRAEIKKFVSIHQALEVARMNLDQNYQPVKMTEYQASIEFGGFSNALPKPKFNGKRNLSPTEDHLKQNNNFYNYYGNVYSKEESDGELGSPHSQQQVLLKQQQQQPQPQQHQPLPPPIAPQVLSNNDYLPNNSFGHQEQPYISLDQINAAHNLDLNSGNTLMPIDTSISTNNLASTHLNGFPYDDNIYTRGINSPLPLHNNAALNYGDYNSLLYRYSSPSLTQSNSNLADGVWGTMTNNGNNLSANDLLNPTQQSGFLISPSQSTNIWLDDKSQNSLLNPTNGTHTRAVSSNSQIWRNDATSLNGGGGSNPIRGFDFGGVSTQGNGDFSPFGNNISIHNPTDSLYGVNLSNTQVNDQQLQSQPQSHFQQQQPHPNLTSFKSDNDENDSVIGGTEQFFK

SEQ ID NO: 20273 - protein, 159 aa, Candida albicans
TAQRSPTTGPSPPPPPTLSSMEYINNILGLLNQVQLVEEAIPTLCNRLQHATMSSDRRSAVLGLKSFSRQYRENVVEHGLRPLISTFIKYIDNPQIVKAILETLLILFIRGESDEDLTRGWISQQSRLQNGKYPSPLLMEYISLDQLSLWIADALIQDE

SEQ ID NO: 20274 - protein, 240 aa, Candida albicans
ILRLLIENLSETNDYHAKLYTIQLLESLASSRGSRTKDCLLNIPTSMSVLCLLLQDSNEPVRNEAILLLMAVANDNFNIQKLVAFENTFETLFDIIAEEGGIRGSILVQDCLTLITNLLQFNASNQKFFLETQCVPRLSSLLGEPVDETGDPDMLDENGFPEIPPPIVWTEQRIQNMIIALEICRLLVSEDTEYVAQNQDKLFQSGIHYILLKLVFSPLTENIVRSVALLTTGDTICGEP

SEQ ID NO: 20275 - protein, 630 aa, Candida albicans
DADRTPCGEDDVVILQTELKETILEVEKERAMLSENSETVIKEYSDKIKSLESKINSIKENHSKEITTHNEQKTSLKQDIAKLSQDHELAQTQLEDKENQLKELKASLEKHNTESATSIEEKNNQIKELSETIKSLKTELKTSGDALKQSQKEYKTLKTKNSDTELKLEKQLEELEKVKLDLQTADEKLKGITEREIALKSELETVKNSGLSTTSELAALTKTVKSLEKEKEELQFLSGNKSKELEDYIQKHSDISEKLKALTDELKEKTKQFDDSKKKLTELENDLTSTKKELETEKTQTSKFKNLEERKDKEIVKLNKELELLKNDNSGAKKELLEKVSKLESEIEILSKELEDKKSVMKQHDELKEQTKEKNQELQKVTKDYSTTKLKLDELQKELDAALSFKDKFETASAKLTQSTSDLEAANKKLNILISEKEKTEQELEKLTKQHAELEKLIDDKNADSSKTNSDLEKANKKVLDLETQLEKLTKELDTNKLELQKHEKLNNEFTNLSKSHEEIKTKLDKIENEKNDLVKSHEKLNVEHKETSTKLQNVEEENKKITAKYESELKKLQDKLKNCVPKSDLDDLMLLMSDLDEKNKAYKSRLKKLGDEVSSDEESEEEESEDDDE

SEQ ID NO: 20276 - protein, 817 aa, Candida albicans
IYSFSKMSHSAYKASGKPLSAEALYHQRVKQGVFQSPSGTIVGVNSNASDTAALLAASSDLSVQPSYVRSVAPEAHTAALAAKQQEIKAWERGQEDPDASAAASNAKRTNTLSSTTPSTTVKVGIPSMNSNTIYKAASANSTSTMTSRINPEKDIRRSGIQSKQGATSLNIDKINKLATKNSTKSLSSRFNPDLDYRSGLKKQAPAEFLNQDEEDLAASGAAASLKHGAGFTDQVSSQKRSQTFTAASVVNASLLKAANEKAELRLNSLKSNNPATLKAQAQLYANALALAQKRSDERLQSRAAGLINLGGGLTISQSELDKLASTYVQPILDDIEGKAEAKRQIDIEKKQKELELQQLHEKAKKEEHEAKEKEKRDIEIAKLERNAQNDKRKKAEDEKYAEYQAGRNEEVQTKLQEYKDVEAKHAEEKQVLLDEKKENQDRIDTEEAEKIAARKQELEELQAEKDEILKPTLDELKEESAKLEEVTNARDELANEVKASEDLNKEYEEKLAELESKLQEAKNDIEKYTTDIEEATAKHESTDKEVAELQELHDKEKADAEKEHEDLDGKLEELEKQKQLHLEDKATKKKDILAAIDEKVKDEHKINSELPEHLREEVDEGKIRDTSSIFSGEEPEIKHVPLIKESETTEPEKKTAKAAEDSTATKAADTTASTASKPVATAATDSTSKRPVTPSAAQSPTKKKSSFSRRLSSIFKYTNTEEKPKSTTTPSSAVKKETKPAKKATETEAEPKKTTETAKAAETTKAPATKQEQPAAKDAEKEAKSVKDGDVSEFADFEDEVSLNRKENKGGVFTEEI

SEQ ID NO: 20277 - protein, 609 aa, Candida albicans
FFVFIYSLPVLLCLSIRIMPSTSKVTTNNHAQDSDSNEFQQLTTQIDSTISNLKQKRDYLQDQLAQFESVRQGLKTSGDSTTPIKFQLDDGTMIEKTTTEAIEFLDKRVTEIKEALTQFNTKINEAESTKEKLNQFNQFVQQGGNHEELKQEKLNEDGLPFVDIQEELDEDGNVINVRFKDAQEDTTIDKNEKDSRGTPKVEILGEEIDKAKKLDKVSQSESDEFQALLEDMEVISKDKKAQELNFDQDDLLDKIDKLQISAEDKFKLKQVCVEEFKNLEPEHDTDKTQENSASDKVIGNFENLAIDKNDLIELELLADDFDDSENFQGENYDDDEEWDYEFDDDDEEEEEDIADELLYGGGKAKIIGSDEKSNNMLWDQIINLRKSKLVATDQVADKIEESTVNEKKPKAVRFAEHLDINEVENISESLRNPPPETGKMSLFKQNRMSSQQKNRSEEIKETVENDSVMTDILENDVMSDIVEKEPVMTDIIEKDDDDQIFENNDITESSIIEREPVATINESTPETKTGTSSQKPVSRFKAMRSSQPLKDTGKLNTQAPVKIPIPGDTEKEVVPLESPTSLSVSKLQDLQLDMDKMAQSSPQGWKIRV

SEQ ID NO: 20278 - protein, 658 aa, Candida albicans
SVLSWIPYPFYKVSHMSSNFFKNTQNNKGVSIFGNTQCSDETGVSSFKIRPSPNIDIDSSLGSEFEMGLDFNKEDLHEKFLDLVFEPKKNVDKSELSLVTTFTESSKSNETRASLNSCTDASIIEHETEPETKKGLDIRTHKTNTLCLFNQPKSNKSKKTENLTSTTKMETKKLITPRVFDGKTTMQLEERSKAKTISILREGVSKTQPQSQISSNFLAVSFSELIGQVEATKCNLEKELDLTRRKLLKVESEKLERDQNIRILTDVNARTKSQVEALFKHVTRLDSDFNDLRHEKDKAGKKYQKIKDDTNRYKAKVGELSSILDESKQSLNSMRMQMQVHFKVKELEIQQKDVQLDEISGLLSEEKIKLAEMQKMSFDLSQWESKMLEMNQNLATDISDRFFNSIKQFIGSENLNNILESKFQFIEKEFKSFLSNEIGSKVAELGAASLDKNQRLSVLVSTEFEKAAMAGIENHATTRDYLLKQFQANIGLIQKGALDVQDVRLEYDQKFKLLESKITHLETRKTQLERELSSHKSLSHDKILHLTEKLHGLQEQLAIAKQKLIDCDSTAERLALNILQAQEELEAKKVLLHEKDTKFYELQKNLEFQLFALQSKVNEENKNRLFFIESRNSLSKEVKVLELVIKNLTRDYEACQRV

SEQ ID NO: 20279 - protein, 448 aa, Candida albicans
ILSSFTMSFSTYVIIIGCAIGSIYYYLKNLELAKLRDDHAKLASHIETIQRNLDSNRDKLQVVEKLNSELIAKSKASASIETRAIAEDKANQEKLKTQLKDITKKYNDLIEEKIKLESQFKEKQLSIISEHNDKIKELQLSKESYESEVKNKLEKTFDFKLNTAIEQVVAGRDLQIQQLTDELSELKKVLEQEITDHNESKVTNERKLLELQQLKDETEKKYDDQTVLYDKLQLVNKLQLEENEQYIKDITAKEEEIESLQKKLKEMNADLTQVTKDLKDSKATIVEIENTTKDLKLSQELLHKHLSLEKDLKDELVAKVEKLEKDITSKQFILDEQDKKLSLIEQPLLVLEDYLEVLKETDDNFPHSLLDREKDVSKSIDNDSDVIKEEEVTFDDDVFSKKSIKVLSLAHKYIDILRQKTVSKRQLIEQQNKDIEDYKTTIDESEFK

SEQ ID NO: 20280 - protein, 746 aa, Candida albicans
  UNSURE (2),(10): Identity of amino acid sequences at the above locations are unknown.
KXGGVGGSGXLSTQVIPKMKPTQKIETFYDTDKTQVIPKLNDVESWFTSKDQTQEDADNVISSKPLSKEEREAKIAKLAEQKRRERLEKERQELEQDLTKGTITDEEEELNQEANDTVVSSHNKSDGLSTKELEKAQEFLNIQKRHVDIRPEFQKKVVFTKDKLLSEFSEEEDCGTNERKTTKDKPPSSPTVEEILKSSPFTSPVKDDHNDDNVLDLFKKPSENTKNPLELYAQRLKKQLFSSPQGQTDTAKNNTKHSKKLINLDSDSDIDLASSSPTKKPPIATSTGIIGSGSKFSNHAKELDNIPELSKEQRLLIKQKFSKRKFQNSKIKTNQLKNHNVSHKQDNGFMQKLREKHINQLKLSKLNNPDHLIMEELEKDEETMTSLLEREMERVRNIRKREKLQERAKLALLEGKLGIKSNNDSEKYGDEIPESDVADSEVPDSDYSMDNDDDDDDEDDLENESPKRAEINPRSDDSYMFGGGDNADGNGEDEGVTTTLSTQPQPVFDNTSFVDKTEGLFQNLQPRTSKEDSFISTQGEESQLQIRLPLFRDLTQVPTQTQVDQFTQVDEQATQADDVATQKILAATQKIMVPTQKIKNDTQIINKPMLQRPANSSTKRDDDDVDDDDDDDIITPANVRRGRKMIRNNNMIKIEEDDEETPSKNNNDHNPKEEEEEENDSDDPEEIQRRIKEYELKIRKRELKLRKRRKEMERKGMKNIVEGEAEESEDEWKGLGGIDEEFSRRC

SEQ ID NO: 20281 - protein, 810 aa, Candida albicans
MSSRSNSPSKTLTENIDKSFSPIKINLTATDDNSPNKLIIHHKTPLRIVHHPHGLSAKHEARRNTIGYSNSIKRRGLVHTPLIPPGSVRNPITSPRLAVRPPINLESIKRTNQKMAQQIKLAFPANNDDDKENELHLDLSSDPDEDYSSPIKRHTRPRNDGDDDNEHSEHLSKIPKLSRPSEEKQTLPETDTNEVEEIKSIEDNLIEENNRSNLAIEEENDNDSDNEEDDDDITKESRGSTVYHQNQTLDNTQISKIIREDLKLDYITPERATEAVAQSPHPHHQHIRLIEEDKTEDFGKFNDTTSPLKTRNQDENEFDDETANLTLLRQLENEPTINFLMSPNSKPVFSKDQVNKIQKEHESKVDTLLQQLNSRDDKIKQLYDELAKVNEQLISSQKEQRALNDEKSKLANSENLLTIQLHHNERELASLTKSFRLKESSLNNLKRKLNEQKVSIDETRHENDTLKSKINELQSLERDLKAEIVETSNSNIESTLKLDQVIKEKEELWIKNQELNEKLQSFESNSSSKYDKLKDEYEDLLERNQTLVDDNKRLETDKFELEDRTKKLEAVNQKLKDDNTNNENLIKEYEKVATSRIEELESERDSTIEEISKHKQIVHDLETQVENLKQQYNDKEKTNKELELRIEELESKSVSNDELQELKRKIDAKDKEIETKEKTIEDYLSKMDDLVDHIKPLKKENEDLKQEQQKLIQEVSSLKDKLEKSKIQADEDLDKLSKYLYAEYAAKHIKKLEGIIKENKKLERELEFYKMKLEKANKEAELLSERKVSSSSKTALSPKITAAPKNRGKH

SEQ ID NO: 20282 - protein, 158 aa, Candida albicans
  UNSURE (3),(8): Identity of amino acid sequences at the above locations are unknown.
FFXQITDXRLLRRRHLVDSQNSNLCEKDRDNLKKSHIELQLKYETIENDYNLANETIESLKQEKLDLQEALDEMTRQQQQQQQQEKEAKEREVLKLNGNKSKELLNDELVVSEAINGFIQDLSRTPSVRDNMKNLESSGTINRDTIKLTPPVSDNEEQ

SEQ ID NO: 20283 - protein, 383 aa, Candida albicans
  UNSURE (16): Identity of amino acid sequences at the above locations are unknown.
HSFKYIPRGIILFIQXQRPPMLKMKRTRIKTNFLGENDDANNLDSFISSQLNKPNYLNLKILIENSIFDTNKITQTSILPLNEVRILKQVIDEKQDLQQYLLSKIAISQSFFNDVIVSQDQDIEKELLIKLMKTQSSLQSKLISTTTELESLKEKLANHNISCLVLGYIEDVKASKNLSANTTLNQSPISSPGKIPNNRDPTSPNKYHFPDRMSQSQTMQHLDSLFAHVASVAAQRNIPLPSPPATDGFDAKITWVQQCIDSILSEENTSTMSTKQTKALSRAASKTRQEYKTALNDLRFSYEYLSKEYEHSRDSSNKLIHDYRKKISQLERDLKTRSANVEELMTPPTTTTGSIGSTRPITTTTSTSTSSTSPSISYDLLES

SEQ ID NO: 20284 - protein, 1078 aa, Candida albicans
PSIPRGRRPICGNPNIQFEFSKVDVPYMDPSLPTQIQPYDRPILVPLSLLNWCLYINSVHAFDIRVASAFCLNSYFKDNKDSKLAFLNDQIKSYTDPTYFTSLHKEEEEQQQQQEINGNSVPTPFGNIFTTLMDYDADLKLNPYTAWFASLIMVNLFLEEPENKEIARNVKTGDEEAGEEVMNSIQAMSGLLVTTLEYKDQRIAMGYLMLLTIWLYEDFDAVNDFLSDQSIVKSILAFLSNNSSDQNVLVHGMATILLGVCYEFSSKDSPLPRSDLHALLVKSLGKDNYSLKVKQFRSNPVFADFEEALTLTFSQDATGLPTVYLTDVYVNLVKDNFLRIKRALFHDPSSEPRGKISYELFEELDTKVLNLTKELQTEKENAESNDKELNEKIEKLTNLSTKLETKLEDKEQELAKIQEDHKLLNEKFLVTTNSLSAMKASKKEFETASQKYQKELQEALKKGNTSESTLKQLKEKLDSTEQAKKKLEDGINNMTRDLFHLKKLKSEAETQIKQREREFKNLTYELENTKKDYELQINNLNKSNNEFKQKINELSKKIESLTEDNKSNAKQLEEKLRDTEENNEHLMDKLRSASVAYNDLKKAKSESEEETVKAKEELETLTSKIDNLEKELKEQQSKKNELEGQLQNITDSTNEKFKELEDELKSIKKSNKEISSQNSELIQKLEKTEKDLQAKDEEIDKLKAETKSNIDNLNSEISSLQSKLKEAEESHSSTKDEHSSLSENLKKLKEEYENTKTSMIAKLSAKIEEHKKATDEIETKTKHITDLQEEHAKQKSQFESERNDIKSNLDEANKELSDNREKLSNLEKEKTELNNKLKTQEEKISDLETSVAISEDKSKSLKHDIEDLKREKIKLETTLKENEETMFEKKEQLQVVNDKCKELEACLKKLTETKEKEINDLIRKLEAAKSDHDTERKKLSLLIEDTKSESEKNVIKLNEQIEKLKGEREKEVRDIQSQLAAKTTDWEKIKTTLDKVLKEKSDLEKTNKESVDTLKKEVENLKKEISLLEDQKKDDTTKYKELAAQLETKTSNLDSTTMELEKTELELKKVRNELTEVS

SEQ ID NO: 20285 - protein, 171 aa, Candida albicans
KLLDTKSCQSLCTSKYSKSDSVFVNRNIRAGYTYNWIVDGLPASMILYDATTSTELYGSGFRIGKVDNENKVEFYNHFEITIEYHKRKEDEYRVVGVTVSPASLDRSELKEDVNGDQLCSLDLKPVQLSKNKETEVLFTYTVNFQESDVAWATRWDKYLHVYNPKIQWFSL

SEQ ID NO: 20286 - protein, 404 aa, Candida albicans
EHIADCHSRAMIPDWRDNSESAGASAGATTISNTLSNNVNTKGPSTDILNDLESAEDNQTTVVGDSIKDFEPDKEDRVPVTTSSTESNGQQTETVELAKSQSDELNTKENENEGSNEIDWNIQEPDFALMDDEVPLQEPTPTNEIEEMNEPHESSSHEDDITPPLTNTQEGGSLSMAKDQVTPENLFISDQQLIDEEALDASENEIIQDEFFVDNDQLASIFEGIDDDIEEDESTDDNDQEFGLEPGKSNRVHLTRIIPQKRKQSPVSSTGVDVSIRDVSYIVKSIQAHKSLNTNLPLRKKFKKPKSLLREIVKSIQEKSNEFLDTLMDDLKSYAEHRQSQTVDMKDVLLYLQRINFAGKGSSTNETEIDRISELAQKFLPLENLIALDNDLYDTISPQKKRQK

SEQ ID NO: 20287 - protein, 180 aa, Candida albicans
EQVKLTDDSVSVISACFEGEGTDRELEVQVVRALMHSILLMPCHGASLLQAVRQIYNVSIFSLTARNQAVAQGILTQVIGTIFQRVEESVKNKSKRNSTHRLTSSSSDDNLEIQASDETENQEKLTLKRLENLNDVINDNDRLHEANFATETDEDLAVKDAFLVFRAIACFSAQPPQKSM

SEQ ID NO: 20288 - protein, 645 aa, Candida albicans
QSLSIMSLDVSLRDRQISILQRMLHLNKEGSADLTLASKSEEIIWKVLVLDAKSRSVLSSVLRVNDLLKCGITVHSLINSKRANLPDVPVIYFVEPTIENILYIIEDLNQDRYDSFYINFTSLINRELLEEFAKKVSISGKSQKIKQVFDQYLDYIVTEPNLFSLNLPEIFTQFNSSNTDEEKIHKLVDVIANGLLSTIVSMDIIPVIRAQQNGPAEFVAQQLDLKLREYLSNTRGSTVATASIQQRPVLILLDRNFDLASMFSHSWIYQCMVSDVFQLQRNTIKITKHAAKDGEKDSTKNYDVDPKDFFWNKYSQLPFPDAVESADAELNAYKNDAKEVTAKTGISSLDDIDPNANATANIQQAVEKLPELTARKATLDMHMDILSSLINELQAKNLDKYFEIEQNATDPKVLKEFLELLVVDSERDSSLDKLRTFIILTLLVDLTPEYIEKVKSIFKEKYPQVDLSSFNYILKFKEHSKLANLSTLNETSNNFTNQASQMNSSALLSGLSSKLYGLTEGKISEGLTSIATRIKSFIPEKKLLPITTIVEAIMDPINASQQSVQLTDEYVYLDPKSRGGHSKPPKRQSYQESLVFVVGGGNYLEYQNLQEWANDPNKAHRKVIYGSTEITSASEFLEECSVLGS

SEQ ID NO: 20289 - protein, 962 aa, Candida albicans
TNIKLNKHRIMSDSGYTLIYEPNTATKVSVNEFKNLLEKGKDDVKVDTMKKILITILNGDPLPDLLMHIIRFVMPSRNKELKKLLYHYWEVCPKMDESGKMRHEMILVCNAIQRDLQHPNEYIRGNTLRYLTKLKEPELLETLVPNVRQCLEHRHAYVRKNAVFALWSIHKVSDHLAPDADELIYRFLYEENDSVCKRNAFVCLGDLNREAALQYIQDNISVIETLDPLIQLAFIEFIKKDSIQNPALKQQYAQLMTEIIESSSNVVMYEAANTLTVLTSNPQSILLAGNKFVELATRESDNNVKIITLERINQLHKQHPGVLQDLSLEILRVLSSQDLDVKKKALDVTLQFITTRNVEDVVKLLKKELQSTALSNDDKNADYRQLLINAIHQLAIKFVEVAANVIDLLLDSIADLNTTAAYEVITFVKEVVEKFPDLRDAILRRLILALPHVKSGKVFRGALWVIGEYALEESLIQESWKYIRGSIGEVPIIASELKLKKRDDTEESQEEETEYDGKPRRKGPVVLPDGTYATESALTSETTDSLESDSKTPIRKQILAGDFYLGAVLASTLVKLILRLQSLKQTQEKILNGLKAEALLIMVSILRVGESSLVSKKIDEDSADRILSYIKILNDEEDLQEIKTSFLEDTKDAFKAQINNAELKKAEALAKDLHDNAEQIDDAIVFRQLDKDNKKSKASVDDVAAASGSNELKKENLSSRLNKIIQLTGFSDPIYAEAFVKVHQYDVVLDVLLVNQTTTTLRNLSVEFATLGDLKVVDKPTTANIGPHGFYKVQTTIKVTSADTGVIFGNIVYDGQHSDDSRIVILNDVHVDIMDYIKPATCSESQFRKMWNEFEWENKITIKSPIETLKEYLDELMKGTNMQCLTPGAVIGEECQFLSANLYSRSSFGEDALANLCIEKQSDGPIIGHVRIRSKGQGLALSLGDRVASISRKGKKATIARV

SEQ ID NO: 20290 - protein, 652 aa, Candida albicans
KVSEYTRGRFIEYTFLQVRNIDSFSLPSTYFKQQLELIQAFNIDKDRSQYYTVMEISKPSTPLSIVGRPPLKNANVHHHKTTLVSVDPITLAINECMIMASAMRKLNRWAQSGAAALFSSGDIFGDDDEQEEGHAEEDEEDEGAEGEQNGSSNNLGVKPSNLDRTNANTNIAVSSRKPSTTQGNPLLASFLQLKSILIDTKNIYDIDSLTLLQPFLMVIKSSSTSGYITELALNTISKFLNYDIISFKSKNLQTSLIQIISSLTHCRFEAADQNSDDAVLLKVLRLLERIIEDELSRLLPNDVVSEVVQTCLSLACNKKRSEVLRRAAEMSMDSMTVEIFSKLKDIDPELDNGDDLQTNFSDTILPEDRIGGTDVPTEINSPRNLISGRENILVDEIHEIKSEEKHQEPKDTRQEDDQQLKVQPVEDETKDMIEVQNEKQENPPIENIPSSSSLKEKTEFDVYSNEEPYGIICINEFLGILVSMISPSNQYQHMESTRVFALSLINTAIEVAGVEIPKHPSLLNLVTDPISKHVLLIITTTESPALLRASLKLFTTITIVLDQHCKPQFELSISLIFQSILPQSEIQMKGSSQMSFRNPISKEILIESLSLLWIRSPSFFTNLFIDYDCDFEKSDLAINILQYLCRLSFLHH

SEQ ID NO: 20291 - protein, 227 aa, Candida albicans
FLEYFLLTPISQTATQLLIIMNNEYDYLFKLLLIGDSGVGKSCLLLRFADDTYTPDYISTIGVDFKIRTIELDGKTIKLQIWDTAGQERFRTITSSYYRGAHGIIIVYDVTDQESFNNVKQWLQEIDRYATGGVMKLLVGNKADLSDKKIVEYTAAKEFADALDIPFLETSALSSTNVEQAFYTMARQIKAQMTNNANAGNAANAKGKSNVNLRGESLTSNQSNSCC

SEQ ID NO: 20292 - protein, 167 aa, Candida albicans
IPYSFLVFRLYMLSKRLFPYSNLFPRLRKYKFIVYFIICLTIIILALGVYLYSIPIVSPNQPQCDMVWMSPSYARIRAFDETHTKYASKYNLYLYREQDVDKMPNENENEDGNEGFTSLDGIPALFIHGNAGSFEQVRSIAARCSEMYYNDGRFKDKYFSPRLQEQQ

SEQ ID NO: 20293 - protein, 213 aa, Candida albicans
QFIMSGKGTSSRAYDMIMKLLLVGDSGVGKSCLLLRFVEDKFNPSFITTIGIDFKIRTIESKGKRIKLQVWDTAGQERFRTITTAYYRGAMGIVLIYDVTDSRSFENVENWFQTVTQHANEDAQIFLVGNKCDDEVNRQVSKEQGQELAAKLNVPFLEASAKSNENVDSIFYELASIIQEKHVEENIGGVGGASGAGGIDVSQNNSGAKNNCC

SEQ ID NO: 20294 - protein, 140 aa, Candida albicans
VYDVTNYESVLSIRDWFNRFMEHCHVEFPGIVIVGNKSDKSTDRCVDLNEIKDIVTTNTTFANVGDYIDDWDNSLMEISAKRLELVEELFVRVAKIGVDLLMGNKGDNKRRLQQFDKIDLRETHNRINDNTTSTSSSCAC

SEQ ID NO: 20295 - protein, 588 aa, Candida albicans
LLLYYYYNFYYLISTMVVLSASICTRGGKALLSRQFRDISRDRITALLANFPSLISNSSGQHTSVEDENVRYVYQPLEEFYIVLITNKTSNILQDIDTLHLFASTVSNLLRNIDEREIFESSFEIIDAFDEVISLGYKENLTLTQVQTFLEMDSHEEKIQEIIERNKELEATEERKRRAKEIQRKEMARKTMDQLHLGASAGVGTSSFGYDSYQHNHQPTYKRTPVVETTHSAGSNTTSSSTHSLLSKPRGGGLQLGGKKTTAGRTLPSGNGAHEPLLATNQPVFAHKAAVESSQTSVAAGSSGVKSGSVSRTGSPAPSNAAATRVPNNGILITVNEKVSAQLSRDGSISSSEVKGDLQLRINQTELANAKILLKIAGDKKQFKTHPNVDRNLFQLESHISVKDKSKTFPSNDQPLGVLRWRSVGKQDDTLLVPIVFTIWVSINEEGQAQVTVEYELTNEFVETHPNHPNVENLKILVPVLTDNVHLQDGGNDTVSYELYDGQGVVFNIGTIAIDDPQGSFEFTIPVVDEDSLFPMQVQVDIINQQVVESDISLGGVSITDVVSNNDDEESLPFDLHSNISFENYVIQ

SEQ ID NO: 20296 - protein, 452 aa, Candida albicans
VTRPHTTTNNSFQHTEKGKKIFFFLFQSNSIQFNSIIFLSNLFFLLLFTFIERSIFSFFFSFLSFPFLSFPCLPFLLNHCMGVILFYLIGQLLYLIRKKYTTTYRQQQQQHQYNMDSKHSTSSSSSGSLATRISNSGPISIAAYCLSSILMTVTNKYVLSGFSFNLNFFLLAVQSIVCIVTIGSLKSLNIITYRQFNKDEAKKWSPIAFLLVAMIYTSSKALQYLSIPVYTIFKNLTIILIAYGEVIWFGGKVTTMALSSFLLMVLSSVIAYYGDNAAVKSHDDAFALYLGYFWMLTNCFASAAFVLIMRKRIKLTNFKDFDTMYYNNLLSIPILLICSFIFEDWSSANVSLNFPADNRVTTITAMILSGASSVGISYCSAWCVRVTSSTTYSMVGALNKLPIALSGLIFFEAAVNFWSVSSIFVGFGAGLVYAVAKQKQQKEQSQQLPTTK

SEQ ID NO: 20297 - protein, 137 aa, Candida albicans
GYYRRTVGALIVYDIAKTESYESVSRWLKELKEHADANIIIELVGNKSDLDHLRAVPTEEAKNFAMENNLLFTEASALSSDNVDLSFHQLLKNIYEMISKHQLENNDSKQTNTAGGPTISLTPAPQEKNNKNNGGCC

SEQ ID NO: 20298 - protein, 212 aa, Candida albicans
EQSIIRLENNFTMKSLFVSLFLFFISSISAHNVLIAPYGIQCFYESLNKNDELAISFQVGSRNPYNSEQYTIDFYINSPQGQTVLKKTGLDHGDETITATSSGKYSYCFSNERTGVVDLDVSFNIHGVVYVDVNDPKLGTLDYAIQKLSQLTDDVRAEQGYLVIRERTHRNTAESTNSRVKWWSVFQIFVVAANSIFQIYYLRRFFEVQSVV

SEQ ID NO: 20299 - protein, 163 aa, Candida albicans
EIIRFVAIISCIILFLVILVIVVWCAWLHRDYPDWINVANLIISIVSFAIATIPESLPVSIAFVLLLTASKMKQHQILVKSLHMCGTLASCSVLCFDKTGTLTQNNMKVTLSCIGDKLHEESEKEENNDIFDSCAATQVFTIGALCNEATIVNNTALGGNATE

SEQ ID NO: 20300 - protein, 334 aa, Candida albicans
KVVEWGYICNNARYFTESEKYVGNPSDIALVECLPHFGLEDMRGQKQRLYELPFSSNRKYMAVCVHTGDIEKSETIAKGATEKILQLCDRYYDENGSVKPLTEAIEESIHEKSRSLARDGLRVLAFAKNNKKFDEKTTEPTDLVFCGLIGMKDPPRPKVGQSIARLMQGGVHVIMITGDSPTTAVNIARQIGIPVVGDHAVLTGDQIDSLSEEALTKAIHDVSVFARTTPEHKVTIVKALQRRGDIVAMTGDGVNDAPALKLADIGIAMGKNGTDVAKEAADMVLTDDDFSTILSAIEEGKGIFNNIQNFITFQLSTSIAALTLVALSTFFRFA

SEQ ID NO: 20301 - protein, 74 aa, Candida albicans
NQPTLLIQQLQIQPTLRSWVHWSGDGHGTAYVVATTGRTVCGSLFEMKSDIEVPPTPLQQAMDTLGERLVHVQV

SEQ ID NO: 20302 - protein, 385 aa, Candida albicans
  UNSURE (362),(367),(385): Identity of amino acid sequences at the above locations are unknown.
KTPRRPLFFLISLLITFSIFFFINSLIVNTEHIFKVVFFFSGQAFSFFFFEFLYTKPNYYRHIVYSSMSANPYDIEHKLPPQRANTPSLKYSQKSIEETAADLQTDIKLGLTNSQDVLNRRSIHGINELNGDEEESLLWKFISSFYQDPLILLLIGSAVISFWMGNKDDAISITLAITIVVTVGFVQEYRSEKSLEALNKLVPAEAKLTRTGSTSSVLAQVLVPGDLVHFSQGDRIPADIRLTEAVHLTIDESNLTGENRPVKKTVDTVNSSDPAVTERTDIAFMGTLVRDGHGSGIVVATAGQTVFGSVFEMMSDIEKPKTPLQQAMDKLGKDLSIFNFIVIGIICLIGIYQGRSWLNMFXMSVSXAVAAIPERLPIIVTVTLX

SEQ ID NO: 20303 - protein, 480 aa, Candida albicans
IGEYCGDLCTFEVKTEGTGRILSHLVFELSSFDQRIKAKYKYNPFIIDFETVPENMWLGITSDILLNDLNHAAKKWLEFENRLALRRFDNEIINASDAFSIDHDYQGLNHDKEINLHILRPTYSAYGLVKLISNLNSHFQTLNIVKYQLQFVSRIQLGLIDKYYDIIKKHYKEYNNKYSFKNALNMIPGAMVDGSINKNKPGNDSTINEHTKNGITLLTEIFCSAKYISDALENWSNELVFIQLWSTYTGLSAELSEDKSIFDSALKQYDDLVNKIFKSYEELFKSEIKQLLKKYVNLSEWDSPSTATRSDKNSELEPSAYLTPLITLLPQYLDIISRSVSQLDYFIISDNAVSSLCQILFEYVLTNNEFNRNGIDQMLVDFEYIVKFLQYSLNLNTLDTYSEAYEYSNDTNSDYVKIVQAIDLLDSVDPDMITNFKQETLDKNTAQLNEFVTKLRLKYQHELKELTNYDIQNLLSRVMY

SEQ ID NO: 20304 - protein, 575 aa, Candida albicans
  UNSURE (571): Identity of amino acid sequences at the above locations are unknown.
KLKMKLDVVKQFSTRSDRVKGIDFHPTEPWILTTLYNGKIEIWSYATNSLVKSIQVTELPVRAGKFIARKNWIVVGSDDFQIRVYNYNTGEKVTQFEAHPDYIRSIAVHPSKPYILTSSDDLTIKLWNWDHNWKLEQTFEGHQHYVMSVNFNPKDPNTFASACLDRTVKIWSLGSSQPNFTLIAHEAKGVNYVDYYPQADKPYLITSSDDKTIKVWDYQTKSCVATLEGHLSNVSFAIFHPELPIIVSGSEDGTIRFWNSNTFKLEKSINYSLERAWCIGILPKSNVIAAGFDSGFVIIKLGSEEPLFSMDSNNKLIYAKNSEVYQSVIKPSSSEGLKDGESLNLQQRDLGSIEIFPQTLNHSPNGRYAAVCGDGEYIVYTALAWRSKSYGSALDFVWNSHDSSAACPFAIRESGVSVKIFKNFQEYLTLDLIYQADKIFTGSLLGVKLEGCISFYDWEHGKLVRRVDLDDDIIDVIWSDNGELLAIVTTSNLGEISSTVGVKKNNETYFLSYNHELFEEALANGELDAEEGAESAFDVLYTLPTSESILSGKFIGDVFVYTTGTTNKLNXFVGG

SEQ ID NO: 20305 - protein, 277 aa, Candida albicans
LSVVPCSGLVKTHKTELNQLSRFFEKLGYLALSFSLSQDFDSKFQLSLSTGNLKQAYDLLSAQEKETPSLSLANSTKWKKLGDLALNKWNIKLAQESFWLAKDYSSLLLLLSSTQNKSQLIKLAEVCESKGKYNIAWQSWWLVGDVGKCFDLLITSERYTEAVIFGKNYGVDPEKLIKAIELWKQTLHKKNKSKVANRLIDDFSNLQTNGSTGAPLIDLESKQDADQETTTQPQQEAKEKIEDEAGASEFQREEVENVEAEIQQDDEVTAEEEEEDA

SEQ ID NO: 20306 - protein, 243 aa, Candida albicans
LPCHYFEKKERNNTRINTMADKFPEIDTPAAGGDDDYEGDFLSREKELVGDEFTTDQDKQVFQDDEDEEINEFKEQFPEVDTKAQPSGISVTKGADKYDDDDDEFEGFESSNGAAKELNLSESQAIKEWKQRRDLEIEEREKLNSKKKEEIIEKAKSTIDDFYENYNSKRDNHQKEILLEQEKFISKRDDFLKRGTLWDRVNELVTEVGELPGDESRDKTRFKELLTKLKGKENVPGAGGYQE

SEQ ID NO: 20307 - protein, 160 aa, Candida albicans
YFQILQKIAIMSFRYSTAGGAHQRDLRTQLFSSPSVGIRTPSKTPPLRTASPYDPSPNNNQAKYNESLLNSLELQNNEEMDTMGQKVAMLQNLGEEMGVEINKLIKLNDDITNGFEKGKITLKNTYNKMIVMSQRAGITWKMWGMVFLIVFLWFFYVWLF

SEQ ID NO: 20308 - protein, 133 aa, Candida albicans
GLIEEFLAKTVIRRCQTFKETAEVISKLGFRIFLNIQPIVENWSNDGKSCSLIIPEPNPLTEFVELPITADNKIAKELWYSQILCGVLRGALQMVQLDCDVSFVKDVLRGDDRTEIRLKLNRILKDEVPAGED

SEQ ID NO: 20309 - protein, 189 aa, Candida albicans
  UNSURE (188),(189): Identity of amino acid sequences at the above locations are unknown.
FKCISITIWWQMSTSIQNRTIEFQQCVSTYDKINKKHNKHVNNSPALSTPKKSYFSQQAGLIAKDISHVTELLSKLAVLAKRKPIFDDKPIEIGELTYVIKQDIFKIETNIQNLQKYLKGDTSVSIDAQTTQFSKNVLTLLNSKMKNVSGEFKNVLEIRQKNEIINKNRTENFYLQSRHQEVVNRAPXX

SEQ ID NO: 20310 - protein, 249 aa, Candida albicans
LPVSLLMNSIYNHGLKQTQTITKDLTQFEKNLSTSPLSLQGAITTSLTAFRKTIKEYSDLLEKNVNDTSYTKHENRLNKFNQDLNEFTLKFDTLKKQRDIQVQEANKQELLGRRHISTTATAALGSTSSDNPYESSSNPSQQQQQQLQDEQNTMSYREGLYHEKNSLERGSEQLDRILEMGQQAFEDIVEQNEILRKVQTKFEESLITLGVSQGTIRSVERRAKQDKWLFWFCVVVMLVVFYYIVKLFR

SEQ ID NO: 20311 - protein, 241 aa, Candida albicans
YRFFGGDNWKLNMFLTPVLVPGILSLVFVVLNFFLISVQSSGAIHMGTMFAIVLIWFIISIPLSVIGSILASNRPLLSVPVRTNQIPRQIPTQPWYLSTIPVMFISGIFPFGSIAVEMYFIYSSIWFNKIFYMFGFLFFCFILMILTSSLITILMIYYTLCSENYKWQWKSLFVGGGCAIYVFIHSFFLTGGEKFGGFSSLVLYSGYSAVISLLVFLCCGSIGFISSLIFVRLIYGQIKID

SEQ ID NO: 20312 - protein, 70 aa, Candida albicans
PGVAPTNYKKGDTIPLYVNHLTPSFHHSSKQGKTATYVYSYDYYYPKFHFCTPKGGAKKQLESLGSIIFG

SEQ ID NO: 20313 - protein, 280 aa, Candida albicans
SLTIPRLQVIHCTLTINSTTLYTYENSNLVHLVNNSNINCSEIVSQELGLINASKTLIGSIPISSSNTIKLSMYFMKKLLSNQDGSRDLITVVAIAHVHANKTLVLNVLKNIMDKYIEYKREFDSNKSVSGQLSKAKLGEFKLYMNQIIKYEEMNYDSNQHIYNYGSTNENNEDGHPADQINPNQLLLANEEVDEVRQLMLENINKLLSRGDKINSLVDQTDRLNTSSLVFQKRAQQIKRKMWFMKTKFLLSITGGVLLILYLFIGSECGFPAFSHCIRN

SEQ ID NO: 20314 - protein, 303 aa, Candida albicans
FDVCKHSYPCGKVCVKLTNFSASIIVVFFFFSTARINMNTSFFFCWLVVHICPATGTFDSINYRLTSTFLQFEYRQNKYYNMVTIGNAHDDLIHDAVLDYYGKRLATCSSDKTIKIFDLDGTDNYKLITTLTGHEGPVWQVSWAHPKFGSILASCSYDGKALIWKEQPETQQWSIIAEHTVHQASVNSVSWAPHELGAVLLCTSSDGKVSVVDFNDDGTTSHVIFDAHAIGANSATWAPVSTSSKDSAALKQQRRIVSCGSDNLAKIWKYDAANNTYVQETKLERHTDWVKDVAWSPSNLIRS

SEQ ID NO: 20315 - protein, 75 aa, Candida albicans
IATASPDRTVLIWNPDRDGKWQKQLLTEENFPDVCWRCSWSLSGNILAVSGGDNKVSLWKENLQGKWESAGEVDQ

SEQ ID NO: 20316 - protein, 138 aa, Candida albicans
KLQPHQLLTLIFPLSFFAYKTPTMSSDKSNLLKKYKIVFLGDQSVGKTSLITRFMYDTFDETYAATIGIDFLSKTMYLEEGKTIRLQLWDTAGQERFRSLIPSYIRDSHVAVICYDITNKKSFDNLDKWIKDVKLERG

SEQ ID NO: 20317 - protein, 114 aa, Candida albicans
VIKPDFMGSTPWIIFYQKTRKLFKINVAQSNLDQLNNDLIDVKKVMTKNIEDLLYRGDSLDKMSDLSSSLKQDSLKYKRRAQRINFEAMLRQYIPIVGAGLIFVFMVYYVLFRR

SEQ ID NO: 20318 - protein, 125 aa, Candida albicans
LLNTALPLCGSVDDENNPNLTDQKKKCKILISRITPNSETKASIESGDLYTIHYLIDNSIIYICICNKSYPKKLAFSYLLEISHEFFNSHGNEALSNKAGLYGFNSLDNFLPKNKKIIQDQRGSI

SEQ ID NO: 20319 - protein, 240 aa, Candida albicans
  UNSURE (11): Identity of amino acid sequences at the above locations are unknown.
VFYSTKCQYCXWFIKINSRGKYTNHAIIYSHILRWCSAVLVSSAIGLHLEVPALPNPQPVCIRDFVQENQMVVVNIKTDGSKGDGQRLDLKVTDLLGNEYRNKKDVVGHANVAFTSQHNAAIDICLTNYLDNKWSKHQQTVRSVELDIESGAAARDWNALQASEKLKPVEVELKRIESITEEIVEELRYLKAREERMRDTNESTNSRVKWFSIVVIASLVGFGVWQIQYLRHYFKVKHII

SEQ ID NO: 20320 - protein, 152 aa, Candida albicans
LISISMSKHRLTNNKNNTNGISKPSSNSVSVENSSTNNPKAGPTPTLKVVLLGDLGVGKTCLRSQFVHHVFTNAYKATIGGDYLTTSVVLPQQIQQSQLSSSTSSLDIKSNFATTKLPSTNTKVNLQIWDTAGQERFNSISQAFYRGTDVCV

SEQ ID NO: 20321 - protein, 474 aa, Candida albicans
KKKKTEVNTIYNKSTTTQQLNKARQTMSTLSYKKQDAYSSNVGIPDKMAVFQECLQQFNASPVNAKKCRQLLAKLLRLIYNGESFPAQESTTLFFSISKLFQHKDQSLRQLVYLTIKELSSISDDILMVTSSIMKDIQGNDAVYKPNAIRTLSKVLDPTTVNAAERLFKNAIVDKNPVISSAALISSYNLLPHAKEVVKRFTNETLETIQSYKLFPPTQFQLHEYYGSSTSNLPSTSYMYQYHALGLIYQLRNHDKMALMKLISSLSEGSSLKNSLSIIQLIRYINKILNDDQSLISHLYPILAGFLKHKSDMVELEACKTLINLQHLIKDDQFMAIVNTLQKLLGVPRTATRFAAIRLINKISIKHPEKIIVVNLELEGLINDTNRSISTLAITTLLKTMGAGTVDTGSVGGESVDRLITKMTSLMDEITEDFKIVIIEAIENLALKFPAKHKKLVSFLTDLLRDDGTLELEK

SEQ ID NO: 20322 - protein, 403 aa, Candida albicans
NWKSSIVDALFDLIKFLPDANAKQLILMNLCEFIEDCEFTELSVRILHLLGDEGPHTSNPSYYIRHIYNRLVLENSIVRSSAVIALAKFAAVCGGEVSKNIVILLERCLNDVDDEVRDRAAISLNFINNGKKNLIVSDSKYDLNALESKLVHYLNNEENFSVKFDISEIKVISSEELKSIEYDRKISKLENSNVENNDTPEVEEQKGGTKVESAGDNVANDLLRQQEYAQELAAIAEFESYGKLTKSTSVPIYLTDKENEIVVSVVKHLFAESQKLVLQYNINNTLPHTVLQDISVIAQPDNELYQEDFIVPLAELKPDQTGIVYVSFSAPAIEDEELLSAFGNTVAYTNKDLDDEGNVDPTDDGWSDEYQIDDLELLAGDFIIPLYNSNFTSIFDQLPNQDS

SEQ ID NO: 20323 - protein, 187 aa, Candida albicans
  UNSURE (93): Identity of amino acid sequences at the above locations are unknown.
CVQQQKIRKKRQLTSSMTDLTPLFRQCVDIVQQEYKTQPTTAKQPYYLNDTFIKETTAFFHVLTNLNQFINETKSSYLAINDDTKLAGSIDDXNKIDEDFNYKVQQMYKRLNHLETYETKRQSLLPKTSGWFSFLDESNDQDIYFETLANHRMQILRFLMETLHHVNKRFENFQQKRLGSWKTTKLG

SEQ ID NO: 20324 - protein, 170 aa, Candida albicans
SKLFKNREMRILMLGLDNAGKTTILYKLKLGKTSKTVPTVGFNVETVKHKNVSFAVWDCGGQERIRPLWRHYFTGTNALIYVVDSLDVDRLEESKQELFRIVTDKELTNCLLVVLANKQDVDGAVKPKDLIERFQLNKLTGEHTWSVIPKIAIDGTGLVETLKWISSHSK

SEQ ID NO: 20325 - protein, 187 aa, Candida albicans
LFTVQDILSSLGLWNKHAKLLFLGLDNAGKTTLLHMLKNDRLATLQPTLHPTSEELAIGSVRFTTFDLGGHQQARRLWKDYFPEVNGIVFLVDAADTERFAESKAELESLFRIEELSQVPFVILGNKIDVPTAVGEMELKNALGLYNTTGKDTGKLPEGTRPIEVFMVSVVMRSGYGEAFKWLSQYI

SEQ ID NO: 20326 - protein, 258 aa, Candida albicans
YQQYAIADDTVGDNIPIMEEDDEDDADEQSKLQKQKVKEAQEQELKRKQEQQQQKAAAKNNNNSGGGGGKFLSLFGGGGNNKKQDNDAKVYKAHLGQKNTFVYDEKLKRWIDKSKPLEEQLQANLPPPPPPSMKKKPNPVSTTTNSNNSSGPPPMVTPNPTPIPGGDLSTTTTGGISTPIPASAPPSRMSKDTTKPTPSINRPKSSLATASGLDDLLSLTDNYPPPNGRSRGVGGGATPGGSRRNKPKRRGYVNVMEK

SEQ ID NO: 20327 - protein, 190 aa, Candida albicans
RQLNFWIEFGKFLNQQGNFIDSEIAYIMAGLPFGHQNFMVLASGHNSMYTEVYEYALNLHKAMHFPHLLSLKLKHALTLADYGLINESQRYIDHINSSIKTLGNKSPFVTPNLLHEFQNLIMRITEVGSGDDQNNWFSGKISRVNLDKIWGQIDKFIVGGDELKNGNNNDGNGTGNGSGSVFNKFSPSVS

SEQ ID NO: 20328 - protein, 879 aa, Candida albicans
QPDFEQNQDLESEKATISIDKKDEDPVLESLTTESDILDNDHESTSEAPGISTELEVFEEEAVVEEVQSTAEDSPVDATQPSELGPLSTEQINLVDEPEAGAPNTEESQTESKLDQFFTESNEGDFFENIARDNVEQEVSNPSKTEADQKLEDLFAGADNENGEDLDFLQQPQHNVAEVNSEAAVATESINLDLFGEDDTDFLDELNSKKQQQQEEEVRPSSSSTTNPEDKLAALDLDDDLLLDDDFLEEGSVQPKVESSLPENKLVKHHHSYIPSGPSANQKSVYAPPQVSGVNKNDFIKNLEQSKKKHDAYDFPDTLLVNKSRPAARHAPSSNKYGPPSVSQTSIPSISSTSSLPPARDVKSSSLAPPAAAPPTGTSTSKVAKKSFFEDFPDDEEIPKPKRAGRAAAPVKAVNQIHSPQVLNQQVQQQQQQQQSQQNAPPAPPPSKVNKQPPVNPYMPKSGTSPILQQQTPAVHKSGIAAPNVNVPHANNYAPPLNSFAFPPRQPNQKTNDYSPQLQSSPAPPPPPTSLQPFPLIGQSQSAPVYHNRQPSNSINTNVNKVPSINSPYVPNAGPYAPLTHQRSHSRASSLVGGKGKEVNPYAPALETVASGDINQIQQQQQQQQHLSPATAVLPPARARGFSNAKSNIYKSAPKVVNPEQLVFRQYPIFSFSINSNCSVIIPNTGYNQGTSINIGPISNLLKDKDLYATFPGPLSKSKSKKKDVEKWLELSSGYLRSLGKNDELVLNDILLHLIKHDGDVKNQEFLRSACLILNPNVNFDVNNLPTSGLAIGATNAHKLDNSGINTVFTLIQSGNLEKALEYCVFRGDWALALIISGPENFNKIAAEYARNTFPFAKTNNKVLHIMPIILKVLGGNVS

SEQ ID NO: 20329 - protein, 117 aa, Candida albicans
LQISTMSLNISLYTISAVLILDNEGNRLFAKYYKSSLGEDSANPSSKFPHQFDTQQQQLNFEKSLFSKTYKVNQDILLYDNHLIAYKQTNDLLLYLVAPLNENESLIYSTMNNLFEA

SEQ ID NO: 20330 - protein, 87 aa, Candida albicans
TILLDNTVDKQTILDKYDMVCLAIDETIDDGIIIEYDPATIVSRVTNPPSAVYENVNLKNIDISEKGLFNALSFASKKLGERLQQGL

SEQ ID NO: 20331 - protein, 165 aa, Candida albicans
KKDKVFFIFSYQKTPMPSTTIEHLDIENLLSENKPIILRCPFKECNTRIIPYSNKLIHLQIHNAPNAIRAVPDNSPELSDKLINFYQINDVWDFDNIGVSRPSSEISQDPIISHDNESTIHIERLIVCSECDRGPLGFAGIPNGKETDHKNLVYFLSRDSVIYDY

SEQ ID NO: 20332 - protein, 287 aa, Candida albicans
QYSIMDFEEAEDINGIRFAWNAFPSTKVEAGKVVVPTGALYTPLKQREDLPIAAYDPIYCSNQSCKLILNPYCAVDPNGFWRCPLCQYRNPLPAHYHGLNPENLPLELQSTSSTIEYITARPVQNPPIFTFVIDLCQDEDNLQALIEDIIVSFNYLPPNALIGLITFGTMIQVHDLGSDKINKSYIFRGDKEYTDKQISEMLNRPISTQLMQQQQQQPGQMNPQLANCLTRFFLPLEDVEFQLTSILENLSKDPWAVANGARRLRSTGSALNIAVNLLGLTYPGPGA

SEQ ID NO: 20333 - protein, 651 aa, Candida albicans
NGPTSISVLDQNCIISCRTCRAVLNPYSPINNSLWTCQICNSSNQLPAMVDSEGQPCYPPNLNPELTTVEYKTGRSSALPPIFFYVVDTIFENDDIESAFQQLKESLTVSLSLLPEDALVGFISFGKHVRIHDLGSNDNLSYTFNGNKQYTLEQLQSSLGLMSSGLSTAGLKQAKDNNGYDQLIGNIGKRFLQPVNIAEYQLTRIIETLVPDRFPHNEYSERPERATGAAINVASLLLKTILNNLHHLTGGHLMVFISGVCTFGPGKIVDKLLKEPLRSHHDIIKAQTTTIQTPSTSHVAKSDINLFKQAKKFYEGITKTLVTLGLSCDFFIGSYDQVGLYEMDEVCYKTGGSVVLSDSFSTAIFKQSFIRFFKKQEEDEQDGENSEYLDMGFNATLEVKTGVDLKIEGLIGNATSLPFNKTVPANERMISTNIVGEGKTNSWKLCNANPQSTYALYFEKLDSVAAATTIQFLFHYQHPSGEMRLRVTTIPVNIIADSDNINLELGFDQETALVLVARDSINKLQPGNTKVATTASIVKQLDNTLIDFCTRFAVYTAGQIESFRLAQTFSLFPQFLYHLRRSPFINVFNSSPDETSYVRHVFMHEDTANSLLMIQPTLLSYDVNTWGSLVDETTGETINEPEPVLLDSLSL

SEQ ID NO: 20334 - protein, 90 aa, Candida albicans
EYQYFKEFLEAPKREAMMLLMDRFPLPRFIDCDEGGSQARFLMAKLNPSTSYATNVNHLYGIGDRSDVFTDDTNLQLFMDHIQRVVTAKK

SEQ ID NO: 20335 - protein, 391 aa, Candida albicans
RPDAFTTSIFKRSFLRLFNKDDEGYLLMGFNGNLEVRTSKELKISGLIGNASSLQVKSANVLENELGLGGSSSYRLCSTSPRHTYAVFFDVVNNQQLPPNAQSYIQFITHYQHSSGTYRVRVTTVSNFLTSDEQTLTNSFDQEAAAVLMARITLFKAEQDDGADVLRWVDRMLIRLCQKFADYRKDQQESFRLGPQFQLYPQFIYYLRRSQFLQVFNNSPDETAFYRHVLLVEDTNNSLIMIQPTLTSFTLDGEPEAVLLDSVSIKDDRILLLDTFFHILIFHGKTISQWRKANYQDLPEYSNFKELLEFPKKEAAELLHDRYPLPRFIDTEEGGSQARFLYSKLNPSVTYNTNDFIGGGGAGGGAIVLTDDVSLQVFMSHLQKLVVSGSS

SEQ ID NO: 20336 - protein, 861 aa, Candida albicans
MSRAQEETEHHSVKFNWNVFPVTRLEESQMSTPLGCVYTPFNDSNVPPQTKGLPISCTTCQAFLNPFIKLDRKNGMWWCPFCQKGTYLPESVNVPEIATSVEDWPIEMRETSTTIDYELPHDITENTTTASPLTYYFVIDRYQHSEEESLNKLLASIVSTIKNNIPLGSMIGIMTFNKSVQLHKISTKKTVEISRDDIPNCDKYWKLFEKLDIEQLLNRLGLTNTLSELDSNNLLRNNYVIELSENNMDSIINYILNIKPTYTEKHKPSRSTGLAHYIYSIMFSQSRVKNFIGKVLFFTSGACTEFPGKIVDENSPIRSHKDIYDLEAPFFPEASKFYTVLSYIANGQSIAQSVEIVKSSSSKTTQYNIDQASPVWSVSLYAGSLDQVGAYEMKPLVANTMGSFFLTETLGSYQIKDMITRAIGLSHHKALLEVSTSIGLKTSKLIFNGGYALPSSYHKSSKYNHLYHIKIDDELGEFDSPHAKKAFTNRWKFNELKKDDTLSLFFKMESAKSTEDLSNGSITEIFIQFKLKSWDVVKNKWVTRVTTIRKPTTLSYVKTSTGKKNHQSMILKEQKFTLGFDQRVWTILLTRLLINKIDTNLGYSSFDELVDLIDSTIVKLLHYFGGISVANSHTQSSNPYYRLQTMYELNQKFKELPSLIYSLRKNSDLIKIFNSSPDETTYYHSWFLRMNMPLSIKVIEPVLINVADHITRLPLDSTCFDLAPADSFLILDTGFTLTLYYKCHNQNKLDLHPSDNDFMIENKESKLPWNIIEQYISERQIVPKIVITQTNHSQARFLVSRLNPTTSDSTKENQPHLDNNKAGFWSFWTSNNRKSSKLIPEDLSLKRYYDDLIEQVQKFKI

SEQ ID NO: 20337 - protein, 311 aa, Candida albicans
MDLASLIFSNRVNTCADISLQLQLNSLFFFPSFHKSNIIWSSLFVILFFFKTKLNKTLTSSTHLFIIISYNTIDIRKMSDGKLFTRSKTTELRTELEQAFKKSKPVVRVKVVLKKVLANIILNNHEVTNLMKDIIPLMKIDDLEVRKLCCEYISTYATTNPDAEDAIPFFSRFHSDPNPLLRVLSLKTMVSINRKEFLNLSITSCKRLFSDKDPDVRKSAAYAAGQIYQHDPARAEREGLIELLNQSLYDENSSVISSALASLGTVIENSKTLNLKIDKNHALTLIKLLRATNAWHSSPTKPTDQQLFSGR

SEQ ID NO: 20338 - protein, 287 aa, Candida albicans
RSYIVQESAIVIKNILRKYPGQFEFAISELIKHYKLIDEPDAKTAFVWILGQYCQNIKESKSILEDFITSFKDDPLDVQYATLTAVAKYYLKFPEQGESVILRVLKWATEEVDNPDIRDRGYIYWRLLSSEHASGPNGEFQLNTKKIILNDNPVITSENDNINPVILEELELNIGTLASIYLKPVQTVFRLSKHKELPYSPALQRRNLFHSGVATPQPQSRNLKEHSPGAGAGVSRRMSYRRTNSDNGSQRSTHFDETTNTQQHMPRENLAQKFSRKASFITNRIKS

SEQ ID NO: 20339 - protein, 168 aa, Candida albicans
FYQLIRLQFKLHIFLYTNYNPFLMSIHFILVLNRQGKSRLVKWFDNSYTPQQKQQYILDIHRLISSRDSKHQSNFVEFQQNKLVYRRYAGLYFLCGIDLIDSELSYLESLHFFVEILDVYFDSVCEVDLVFNFYKLYYILDEIYLGGEIQELLKKKILNRLSYLDGLD

SEQ ID NO: 20340 - protein, 268 aa, Candida albicans
SDLPAAWVKKINLELSSNGGSGNSQYSNLLQKVLELATKECENADVRDKAYIYWRLLSSSSSEDQQKKILLTKLPPIETTISSFSPGLLETLLDELSTLSSVYYKPAKSFIDPNAYSRVPVEKKNKTKIEDLKNMAKEEIITNARNDNLLDFDDDDDEEGDGVSGSNGDSGNVGNLLDELNDLFSTPPPPPSSSSQNSQLQIAGGQTSTNDILSLFNTINTTTTTTTTPQQSTQSSTTHGIENLSVSRNASTTTKKLYHVNNDLLDLF

SEQ ID NO: 20341 - protein, 300 aa, Candida albicans
LCLNECTEWGRITILNTLAEYDTDNSEEANHIMERVIPQLQHVNPSVVLSSIKAILHHLNAIPVTAQRSNILKKLSAPLVSLVSTSIPEAQYVGLKNIRIILEKYPNVLSKELRVFFIKYSDPLYLKLEKLEIMIRLASEQNSALLLGELKEYAMEFEPALVTKAIKSIGSVAIKLQESAVKAINLLHEIIDERGGDLIINESVTVLVNILRRYPAKNDLATLIIPVISNHVNELNKTEALSRYIWLIREYPKYFPGLDKKFSDLFDGFWKNDSVFTIEYFILQLFKINLALYLPMGGNG

SEQ ID NO: 20342 - protein, 123 aa, Candida albicans
PTMSSSYKQTINKNFNKVNSILERKLRKYLVGPKKGETFELKNGLVSQYKHERKDAIQRVIQAMTVGKDVSSLFPDVLKNIATYDLEQKKLVYLYLMNYAKTNPELCILAVNTFVQEYENPIL

SEQ ID NO: 20343 - protein, 184 aa, Candida albicans
GLRTMLYHILLLIHVALAVVPNIPKISSQLLPNPHYSLPNLLSIESKEDINNFDISNNIQFDNGRLLLGELGSIWGKYKIPTLNKPWTIELIFRSTGTKEDRKYEDNSLNVWLLNEDNNNLPFDSFDGFEISINNEGQIPGVKLYNNDGLQNIIHDASHVLGTCKFQYLDSDVPFTLRISYDAN

SEQ ID NO: 20344 - protein, 129 aa, Candida albicans
ESTVMAIQFLFLISRQGKTRLSKWYQTILQKEKSKIIRELSTIILSRRAKMCNVLEYKDLKIIYRRYASLFFVIGVNSDDNELIGLEIIHRFVEQMDKIYGNVCELDIIFGFDKAYHILDELLIDGYLQ

SEQ ID NO: 20345 - protein, 107 aa, Candida albicans
NNHSPVKKMLKKNDNITYDVEKISIENPLPAKEFNDFHDKLDVEKYGETKRKLNLRHVNLLMIGQSIGSALFVSIKKPLHVSGSLSFFLAFAIWACFNDIPIDASYW

SEQ ID NO: 20346 - protein, 284 aa, Candida albicans
SRLYYKMWHKEKSREAEKGEIREDELFNTKVDRQTSAYSESSLVHDNSSVDTDHTQRKLYNRHLQLIAIGGSIGTGLFVTIGTTGLTVGGPLGLLLSYCLSTLLTLLLTSAVGEMVSYMPVDSPFLNMAGRVIDPAFEAAASVNFWVMQSLYIPFEITAVNGMIHFWRDDYSPAITFCIQIAIYAAINLYAVRVFGECEFWFSLAKLILCIGLLFFTLVTMCGGNPKHDAFGFRNWHAAGGPIATLYTTGSLGRFPGFLGSFRWSSSFTCVGSEYLGMDRWWMY

SEQ ID NO: 20347 - protein, 290 aa, Candida albicans
PSSPLTPLHSGTVLYRLVLFYIGGALSVSILVAYNDPKYLELTSDTSNAASSPYVVAMQNLGINVLPHIVNAVILTSAFSAGCLYTYTSSRCLYNLAKKGFVPKFFKKCTSHGVPVFCVGLSICFSLLSLMQLGSSGSKVLNYMVNLCTGAQILNYAFMSITYIGFYHACKAQNIDRHQFTYRSWFQPYSIYFVCFMYWCLVGILGYNVFMPGKWSVDTFLYNYIMVFVSLAVFIAWKLFRRTKFIKPIDADLRTGLEEIERHEYEYYEQLEQSSNKPDNKFKSILHWIF

SEQ ID NO: 20348 - protein, 74 aa, Candida albicans
WDTMFFFSSYGSIMIFTVLYVGYRFIKGTSVPSLDKLDFDSGRTEMDRYIWDGGRSYNKRNVKEVAHKLVSFLA

SEQ ID NO: 20349 - protein, 446 aa, Candida albicans
RFTIVGTLVLCTIMSFCEMVTFVSVIDGVSGLSSRFIDDAFGFAAGWLYFLSFSTGVAGEVVAGVIMLSYYPHLNTATNTGSTAGFVTLFLALILGSNLVHIQFFGELEYISSLVKMIWAIIMMIVMVVLNRGGFPNTPVMGFKYWQYLKSDFANNIIFGLFRPAFNLHDDGTSSPSEGIGGDKGRFMSLLTAILVVCYAYSGTEIVCIAACEAKNPRKALPSATRRVFWRIIIFYVLSAFLVSLNVYAGDPRLLRYYLGSTGISPSEFATNPAVIQAGGEHCSIDYKVVAGYGSGAQSPWIVALQSSSLCQFSSITNGFLVFFAVSCGNAQLYVSSRTAYSLALQGKAPKFLTYCNRFGIPYNAVLFAGSFGLLAFACVNESATVVFQNLTSLIASSGIFVWFTMCLTFIRFYYGLKRIPTFWIEMINHTLINHLSNHIQLLLDV

SEQ ID NO: 20350 - protein, 127 aa, Candida albicans
NFPKIIWIWNLDFVDEKSLDNNFIPTREMKKKKQIEIKEGYLRKRSKKNSLGMSADSRTATMIFLDSYQSSSSDVVSDDPRFLQRKLSVRHLQMISFGGTIGVGLFLNSGKAIAMAGGFGAPVSVSL

SEQ ID NO: 20351 - protein, 396 aa, Candida albicans
SFCLFVLPSNIFDTMFKKEDQAVSKEVRPEELGSFTGSEEKYSSNEFLNTESKTGFQNFIDSFRRKQATEDESAGQQLAKGISKRHLILMSLVTGIGTGLLVGTGQVLRKSGPLFLVVGYAIAGSFVYPTLQAAGEMAVNYSELSGGYNSYTRMFVEDSINFAISWNYCIQWLSVISIELVTAAITIEYWISETRVNPDAWVAIFYVVIVVIHFIGSKAYGEFEFIIGLIKVCLLVGFIIMGIVVDTGGGPTGEFIGGRYWRDPGPTKNGFKGFCSVFVTAAFSYGQSEFVALSAAEQPNPRKAIPTACRLIFWRIIVLFLGSLTIVGLLVPSNSDHLMSEGGGSNTSPFVLSAALHGVKAVPSIINAVILMSVTSVASSSLYSASRSSPRTADPQ

SEQ ID NO: 20352 - protein, 576 aa, Candida albicans
VFTSIMSSSSTASEVHKAPVVKNIEKQDMDMYSASSSSAPKTTWNNFIDSFHRADGKTSAESKDQRISKTELRIMSLSTGLGTGLLVASGSKLRAAGPAGVLVAYFITGICMLAPTINSVSELAIAYPGLPGGFQSYYAKFIDESLGFALGWNYAFQWMCVLALELVTSSMIIKFWTTTVNPDVFVAIFFVFVTLINMGGAKVYAVFEASFNCCKILLLVGFVIFGLIIDVGGGPQGFIGGRYYHDPGAFTSFKGLASVFVTGAFSLGGSEFISLSASETRHPRASIRAASKLVYFKVIVLFLGSLTFVGLLVAYNNDRLMGTGDAASHASPYVLAAEMNGIRVLPHIINAVILISVVSVATAAMYSSPRLVQSLAEQGLGPKWLDYIDKKGRPTRAWFITVLAGLFGFIAAYEKQETVFVWLLSISGISFIMCWLFICVSHIRFRAALKYRGITLDQLAYVSPTGVWGSYLSVLINSLILIAQFWISLWPLGGDGKPNANSFFENYLGAPVFLVCYIGHKLWTRNWKLFKKVEDIDIDTHRMICDPELLALEDLEDKERYQKAPIWKKILIKCFD

SEQ ID NO: 20353 - protein, 575 aa, Candida albicans
CQQKNRKENIMEKSNNQIVTSEKAQDNISCSAVTTNSKQHLGFVDSFIDSFRRAPESNTSAENKRQTISKNELRLMAISTGLGTGLLVATGGRLRAAGPAGMVIAYAITGLVMLAPTVNSVAELAIAYPGLPGGFQSYYGKFIDESLGFALGWNYGFQWMCILALEFVTVSMTFKFWTTSVHADVFVAIFFIIVTLVNLGGAKVYAVTEAALNSIKIVFLVGFIIFGIIIDVGGGPNGFIGGKYYHSPGAFTSFKGLASVFVSGAFSLGGSEFISLSASETKHPKTAIRAASKLVYFRVIVLFLGSLTLVGLLVPRDSDNLMHGSGSSVSPYVLAAKLNGVKVIPHIINTVILLSVTSVACAAMYSSPRLIQSLAEQGLGPKWLDYIDKKGRPTRAWFITILAGAFGFIAAFKDHETVFMWLLSISGISFVMCWLFICVCHLRFRSALKLNGIDVKTLEYVSPTGIWGSYISIIINSLILVAQFWISLWPLGGDGKPNALSFFENFLGGPVFLICYIGHKLWTKNWKLYKKVEDIDVNKDRVVKDTEILHLENLEDKERYEKAPLWKKILIICFD

SEQ ID NO: 20354 - protein, 212 aa, Candida albicans
KTIIFNFIFFFGIKKPLIYLNRKFLFLLFLLVSHLSYYYNQMSEPTKNLELIRSQELDSDHSISYDSTTGLKHGLKDRHLSLIALAGIIGPGIMIGASLALASGPAALLLGFGIIGIVAFCMMQSLGEIATMYPTGATFSTLGAKFVDYSWGGAVGWNYVIIWIAVLANEYNTTASVLQFWGPQVPLYGYVLILWAVFTAFQFLGVSAMGSV

SEQ ID NO: 20355 - protein, 204 aa, Candida albicans
  UNSURE (13): Identity of amino acid sequences at the above locations are unknown.
DVCPHLINALIIXVCILAISSSIYTGSRSMVNLANEGCAPSILKRVNGQGVPYAAVILMSTLGLISLMNQSTGAANAYQYIVNLSGVAVFIVWGNVCFYHIRFRQAMKLQGRSLDEIPFKGMLYPYLPILGLALNVILALIQGWSYFKPFDAGNWVDAYILLPFFFVLYFGFKLWHKSKWVNLEEVDLDEGRSEDDEMRVTATD

SEQ ID NO: 20356 - protein, 437 aa, Candida albicans
VKTQGRHLGLFSTVILFVSRILGSGIFSITSGIYQDCGQSVALFFAAWVIAAIASFGGLYVFLEMGSLVPRTGGAKVFLEFIYPRPKLLATVAFLVYSVMFGFTISNVLVFGEYLIHALGLEPSDFKTRFTGLIFLYFAAILHGVSVSHGVRIQNVLGGLKLVLVVVIVVAGIYVTAFPQSITGIENQLEWDRVFEVRSSASVLTFASAIIKASFAFSGWNSVHTVANEIKDPVRTLKIAGPVSLTIMAVTYFIANLAYLIVIPSDELANGSTLAGSILFTKIFGQFLGKKLLTLAVSLSAGGNIFVVIYTISRVDQEVFREGYLPFSRFMSSNWPYGAPLRTLLLSVAITTTVIVLFPGGDIYSYMVSLEGYPQQLAIALIAIGIFIIRKRYPELHSPIKAGVVGTIAVFLISLYLLIGPFVSSKIMCRPRVKDPR

SEQ ID NO: 20357 - protein, 484 aa, Candida albicans
  UNSURE (7): Identity of amino acid sequences at the above locations are unknown.
VATSRLXKTVLSDQKYSNILSWFTGWFLLIGNWTYAISIMSSGAQFILSIFGMKNVYIYKEDRFLVLSVYFILLGFCGFINFKYSKHLEKINKACILWTIYTVLAIDFLLIFSSTRTNSIKDILTKFDNSRSGWPDPLAFIIGLQSSSFTLTGYGMLFSITDEVKTPEKNMPRGAISAVFMAIVTGVIFIIPILTILPELEILLDETPNIMPIDLIFKLSTELYLISFLMACLMIGTMIFQSIGSLTTASRSTYALARDGGLPFADLWTQVNSIEDYKLPKNALFLSMVICAILSSLSLISQSAFNAFMGAAVISLALANGVPILCLMINKRKKVRGAAFKLGKIGWIINGLSIFWILLSVFILCMPPVIKHLTWSNMNYAILVIISFAIIASLGYKTWGEKSFTGPVIDNDYFELNNLETNVISIRQAGAGTAGAGGASTASGDVNDDDFVIIGNDEEEEEEEDDDDDEPDTNSSKSKTKDWD

SEQ ID NO: 20358 - protein, 175 aa, Candida albicans
IVLIMSSFSPDIKKTIEVEVDASSFHSDSVDFTKDDIQDAESIFHNEKQLSEGLNTRLIGMISLVGVFGTGLFLSSGGTLATAGPVGMILAFVLVGIVVAANQISTLEVACLMPVTGSNIRHVEHFVDKSFGFALGYVNVYSAIIPSELAATSVVVSYWTDINPAVFITIFGVVI

SEQ ID NO: 20359 - protein, 254 aa, Candida albicans
EHLSLIVPYNDKSIASPTGNAAGSAWVIAVQRSGIKVLPHIINAVVLTSALSAANLGLIHASRSLFGLASNGQAPKIFLKTNKHGLPWVGVVFAALFLPLSYLSVSSGTSQVFSWFQSITSSNLLVNWSVFALDHIALHRALEAQGYSRENLPYKIPGGQYAGPVSLFFSLLFLFTGGFAVFIKGQWKFANFFSSYFVIPLFFGLYIFSKLFFKTKYVKPTEVKLKPLFYDVIDRPEPPIKKLKGWEKISLLWG

SEQ ID NO: 20360 - protein, 127 aa, Candida albicans
QLLTNIISLVYSSGGTLATAGPLGMIISYIFVATVIGANQIAVTEVTCLMPITSGYIRHAEHFVDHSLGFAMGICNIYLAVIPTELSAVVLIMTYWTDLSPAVFVTIFGIVIVVINSCTVRCYFRPS

SEQ ID NO: 20361 - protein, 133 aa, Candida albicans
SNLLVNWSVFALDHIALHRALEAQGYSRENLPYKIPGGQYAGPVSLFFSLLFLFTGGFAVFIKGQWKFANFFSSYFVIPLFFGLYIFSKLFFKTKYVKPTEVKLKPLFYDVINRPEPPIKKLKGWEKISLLWG

SEQ ID NO: 20362 - protein, 347 aa, Candida albicans
  UNSURE (257),(260),(263),(313),(314): Identity of amino acid sequences at the above locations are unknown.
MVFGYNSDKGLLNEEKRSSTADLESVITQHTNNYDLYIARSNPSAHNAEEGHQLRQELHARHVSLIAIGGALGTGLLIGTGLALKTAGPGAILVAYGAIGFVVYMVMTALGEIASFIPLPGFANYGKRYADEALGFACGIVYLIKYLVLPANQLTAGALTMQYWVSRDRVNPGVWITVFLVVITFINFLGVKVFGEIEFWMSILKVLTCLGLILLLWIIALGGGPTHERLGFRYWKNPRAFIHYSNSAQNVAIGGSXGRXVAXVSVLVTAVFAYLGSELVAVTFSETRNPRKAYPKAINLTLYRILVFYILSXXIVGMCVSSKKSLLLGGKGYNAGTNPFVIANKKA

SEQ ID NO: 20363 - protein, 188 aa, Candida albicans
LAGESEYPRRAIYRAAKRVFYRIAILYFTTVLVLSMIVSHTDPAISKPDGTARGSAFVVAIQRSGIKVLPHIVNAVVLTSALSAANLDIIRSSRIIYALASKRQLPKIFLKVNNYGLPYVAVAFCCSFLPLAYMTANATLAAVFSWFQNITSSCTLLNWSIISINHISMSRALRAQGSIRHGRGRTAL

SEQ ID NO: 20364 - protein, 380 aa, Candida albicans
TAQRHNIGISQNDDEYLNKVYHEEVMGQINKIEERRRNLQEEFQSIGRVLDVSDLEYQFLTLLASSFSSVSIRWQKGACIGRGTFGQVFSAVNLDTGGVMAVKEITFHDSQSVKTIVPLIKEEMTVLEMLNHPNVVQYFGVEVHRDKVYIFMEFCEGGSLAGLLTHGRIEDEMVIQVYALQMLEGLAYLHQSGVVHRDIKPENVLLDHNGVIKYVDFGAAKVIASNGRTIGGMTNSSLRKSVKRDGHNNLNSMTGTPMYMSPEAITGTSTDRSGVVDIWSLGCCVLEMATGRRPWANLDNEWAIMYHIAAGHKPQLPSPEQLSEPGRTFLARCLEHDPTKRPSAVELLADPWMVEIRHMAFGNSDVTTTPLSEVAGPVSE

SEQ ID NO: 20365 - protein, 873 aa, Candida albicans
YNYLIMSDIPPTNESNLDSTLINQKNNDNNDNKETGKDISSTHTHHRVTFAEQQPISTSSRKSSLLRTHSLNNTSSDSDKRPSIISRNSNPDIHRDSLPPLNRGPSYNGNYTRSHSSRNVNANNTINTGVTSDSNSNNNVDSNAPISSPTTPAISSPPANGKYFNLVLPAGKSREKSPGRHSKEGHTRSRSFTKQQHGIGSTSSQLSSQYLAQEKAYLRKMRNQSVDDYYSKGIPGAHEVSKADDNDDEDDDDDEEHSSFDGGDNANLLAAIDDDKYQIDYSMALSLMKNSNVNLRKIANLNTDDTDDPAIIERMEWQSMLTSVLTGDVVRSEKTKIININNPDSTQESYLHATFKENLWFGIRAKIFNRTEDEQRKIVAYRRTLVDQLIDDVMKFEIDYENSTDNPIRDQVKTILDRYDQACSLWKTLEDMYSDKPACRSEEFQNRIDALTAWLTITDAISRETKSLRLWIGNDELDITKSPVEVSSSNAATSTSKIVKKIFDEDNKSLAERLMKEKDVQTIFRKRIFKPIAPWMIKSKDTYIRLGVIFENMKLPDYLHDLLQICIIPVRLIKEIVIVRLGYAMKLQNPTLMMIDQMLDDFKSYITVALEVKSGILEYKEPDEDRKWLISDLFDSELEDFDNVILRCVRYFLVLLNRKLLDSSRSPTTFRTFKEPEELEEAWNFLKPLGHYVDGGSVVVAEEITMLALRLIHRLMAYFNHQIREPTYNGVPQDLIRWYSSTSENFGQLRRKLARFMGEISRDFKNSVVFDIPSQSNCTKTLLEILRSSNHFLVYTGTVETQGTYFFASPELLGNEQEILKILTGSCVGLDPSTDNLHFTDLLHLIRSGSEEHLRYNDHDLDVFTTPGDPASM

SEQ ID NO: 20366 - protein, 257 aa, Candida albicans
SKKKPFIYSFSSSQMRDKKQTKKINSFFFATHSTMSQQPHLRVGSTAPDFKADTTNGHILFHEYIGDRWGILFSHPAAHTSVCSTELSAFARLEPEFTKRGVKLLAISADPVEANSDWIDDMEDFSGSRVKFPIIADPERKVATLYDMIDHQDATNLDDKGLQLTIRAVFIIDPSKKIRLIMTYPASTGRNTAEVLRVLDSLQLVDKQKVITPINWVPGDDVLVHMGVPDDEARVLFPKYRAIKPYIRLTPLEKEDK

SEQ ID NO: 20367 - protein, 452 aa, Candida albicans
  UNSURE (211): Identity of amino acid sequences at the above locations are unknown.
SVQAVGAGTIADLFIPQERGQAMGLYYLGPLAGPFLAPILGGAVSQAWGWRATQWLLMIISACSFVLITFFLPETLRRVDTIQVAKDLMKKLDNNGLQNEKIHDDFAGADNSSVHDIDGNPIPGTELHQVVSNLSRRSSNARSIVTYMEEQENEGPIIDPVMPSISRLTTNRSAYSQRIHQNYVTDELRKTTSNLTQSNHPQYNNNNNNDXDKWSSVKTNCYDLIIRPLHSIILLKHPPVVLVISFSAISFAAIYFFNMAISYEYARSPFNFSSVILGLMYIPNSVTYFMASIIGGKWNDRLLNRYAQKHGELVPESRLSWNIVVAIILYPMACLIFGWTIKYREFWVIPLIGTALFGFASMLVIGATVTYLVDSLPGKGATGVALNNLIRQILAAIATFIVEPLLRAIGAGVLFSIIAGILLVSSLVLLYLKKRGAFFREHYDVMDLYAKL

SEQ ID NO: 20368 - protein, 519 aa, Candida albicans
SLILFSICLSIIFQMNSVTNPEIMPKKEEPKQNETEAETENKLSTAELKNGKSVSNSEKQNDLEGQTSQDSPYCALSLKRKTIIIGIVTIAGCLGPISGNIYIPILPQLENEFHVSTQVINGTVSAFMFVFAIAPLIWASWADYGGRKTLYLIPLIFFILANILLAATPANIVGLYILRVLQAFGASSVISVGAGTVADIIEPKHRAKAISVFMWGPQLGPVLGPVLSIIASKGQWRWIFGFLALFGFAVYLMILFFLPETLRYLVGNCACYKDTSIIVKPHLRQKKIVEGYPVPPKPSFKNYWILIKFKPVLLCSINSGLLFATFYGLMVTFAHVLKIEYSFTDAQISASYLCPGISLIIGSTIGGWASDKIRAEIIKHNPDIYVPEYRFSLQFLGLIISMTGVIGYGWTVHKHTNVVAVFIFTFLGGFGMTWVFVANTTYLTECTTGQPATNVAIGNFARNISATICTAVIDPLISSMGFGWCLTGLGLTNILGIVFVVILLKWGPSWRRQFLNKST

SEQ ID NO: 20369 - protein, 125 aa, Candida albicans
VGGGILTSRSGILHPGVTSGEGRFVLIGSALMYTIHPHSSAGTMYGYSALIGIGAGMYLQIGHAVAQAKVKLEKIPAAVAFTTTAQLNGLTFALVISQCVFVNEAAKRKFAFPFALWAVHLRFCL

SEQ ID NO: 20370 - protein, 487 aa, Candida albicans
KIHLSFSSITPVHAMVLPSSYKESLNDFPIRQMIIICIIRFAEPLAFTSIFPYIYFMIRDFHIAIKEEDISQYSGYIASSFAICQFLFAIHWGTMSEKLGRKLILIIGLLGTSISLLLFGFARNYYWALIARCLAGVLNGNVAVLRTMIGEIAVEKRHQPLAFLTMPLLFNFGAIIGPAIGGSTYLTKPKEKSPYEEKEDKNIYQVVDDWDIYQIYQQFLDRFPYALPNIVVALILWFSLGCGILFLEETHEIHKYRRDYGVDLGDWLLSKVGISTPSRPWHNRNYHHPISHNNFGDNVGETTALLQEIEGEDVFPEADPESIPLPAPPPQQQPLSKPSSIAFTPKVIGVITGNFIISLHSVAYNEFLPIFLASRFQPKSLKFPFQIVGGMELDTNYIGTLFSSTGIMGMLIVLVLFPLIDSKLGTIGGYRLSVSIFPLIYLIIPLTIFTLHQYNDWFPNWTTPILLYSLTSLKTLANSTGMPQLRF

SEQ ID NO: 20371 - protein, 306 aa, Candida albicans
PKTVRKKKLQFKLHFHFNNLYLFFSSFFYLWSFIYLVSKETSYRFTYIHLKKQGQPQATMTKKMAKISFREQMKGFPLWQMFVISCIRFSEPIAFTSLFPYVYFMIRDFNIAPHSTDIAKYSGYLSASFAFCQFFCCVQWGKASDKYGRKKILLMGLLGTAVSMIIFGFSPNFWVAVFARSLMGCLNGNIAVLRTAIGEIATHKNHQSIAFSTLPLLWNFGAVIGPIIGGSKYFTRPKQRNDIDNYQLGELLRLGKIFMLMAQDPQLPSSNDSDNLYNRFMNKYPYALSNIVIAGILMFSFITGVY

SEQ ID NO: 20372 - protein, 123 aa, Candida albicans
VFTHHVYNSANPPWLTKTLLYVLCCILTASNAVGFPNIIVLIHRSSPEQHRAFINGTSLSLNSLARFLGPMLWGYVMTISEVLEIGELSWILLGGLSLICCTYAFIMKDNEDDEDDLIAEDNV

SEQ ID NO: 20373 - protein, 314 aa, Candida albicans
IFCWWGKVVLVKTTTSSSIAFHWALQHPNDEFFLISTDPAHNLSDAFCQKFGKDARKVEGLSNLSCMEIDPEAAMSDLQQQAQQYNNDPNDPLKSIMNDMTGSIPGIDEALSFMEVLKHIKNQKVNELDDSKDKISYRTIIFDTAPTGHTLRFLQLPSTLQKLLGKFQQLSGKLGPMMSMLGGGGQGQQDMFAKLNEVQKNVEEVNEQFTNPDLTTFVCVCISEFLSLYETERMIQELMSYQMDVNSIVVNQLLFADDDENPCKRCVARWKMQKKYLDQMAELYEDYHLVKMPLLGSEIRRVENLKKFSKFLIK

SEQ ID NO: 20374 - protein, 282 aa, Candida albicans
WASFVLPLPGEGPIYGHLGESLNGIDTIRAYDQKARFDFIMNANVDFNLKSVYMLTSINRWLGFRLQTIGGVGVFSAAILSIWSVHTARPLSPAMAGFVMTYAMQVTSALRMLVRTSAEVETSIVAVERCLEYTKLPVEEEPHLKLIKPPKHWPQKGVIKFNQYSTRYRENLDLILKKITFSINSAEKIGIVGRTGAGKSSLALAVFRIIEAVEGSIEIDGIITSQMFLQDLRHRLSIIPQDSQLLKGTIRPNLDPFNYYTDKEIWHALELPHLKDHIEETT

SEQ ID NO: 20375 - protein, 571 aa, Candida albicans
WLEHWSEINTKYGYNPNVGKYLGIYFLLGIGYSLASLIQNTYLWIFCTIQGSKKLHNSMAVSVLRAPMTFFETTPIGRVLNRFSNDIYKVDEVIGRVFNMFFSNSIKVFLTIVVISFSTWPFLFLILPLGVLYIYYQQYYLRTSRELRRLDSVSRSPIFANFQESLTGVSTIRAYGKEERFKFLNQSRVDKNMSAYHPAINANRWLAVRLEFLGSIIILGAAGLSILTLKSGHLTAGLVGLSVSYALQITQSLNWIVRMTVEVETNIVSVERVLEYSRLKSEAAEIIPDHRPPQDWPQQGEIKFNDYSTKYRPELDLVLRNINLDIKPKEKIGIVGRTGAGKSSITLALFRIIEAFDGNINIDGIDTSSIGLYDLRHKLSIIPQDSQVFEGTIRSNLDPTDEYTDDQIWKALELSHLKDHVLKMHNQRETTEEEEEEEENGETNPLLVKVSEGGANLSIGQRQLMCLGRVLLKLNYSNILVLDEATAAVDVETDQILQETIRNEFKDKTIITIAHRLNTILDSDRILVLEKGQVAEFDTPSNLLKNKDSLFYALCEQGGFINDEPKVTAIE

SEQ ID NO: 20376 - protein, 750 aa, Candida albicans
VVIPNEDGWGPLSSTYNDLTPCFLQGILFGISAILMILVGIYQIIYLINKKITVGNKINWNFYLKLFLVVIQIGFQIGLILVFNNDIGIIKLSLILNSIATMVALGIHYLEQFKSTIPNGVLLFYWLFQVILNLARIGNLYLRNSFGKNNDKGFANLVILSTINAFIILIVEILFPIQPLNNYYHRVSLKESPLDQANVFSRITFDWMGGLMKKGYHKYLTEEDLPSLPKSLKANKTTKDFDHYWNAQSTNNKSLTWAIAQAFGGQFLLGGIFKGAQDALAFVQPQLLRLLIKFVNDYSKSVKKGDPIPLTRGLLISVSMFIVSVVQTASLHQYFQRAFDLGMKIKSSLTSVVYNKSLVLSNESKQESSTGDIVNLMSVDVQRLQDLVQNLQIIWSGPFQILLCLYSLHELIGNAMWAGVAIMIIMIPLNAVIARTQKRLQKTQMKYKDERSRLINEILNNIKSLKLYGWEQPYLKQLNYVRNEKELKNLKKMGIFMASSNFTWNLAPFLVSCSTFAVFVWTSNKSLSTDLVFPALSLFNLLSFPLAVVPMVITNIVEAQVAIGRLTKFLTGSELQTDAVIRSPKAKNIGDTAVLIKNGTFLWSKAKGEQNYKVALSNINLTCKKGKLDCIVGKVGSGKSSIIQAILGDLYKLDGEVNLHGKVAYVSQVPWIMNGTVKDNILFGHRYDPQFYQIVLKACALTVDLSILPKGDKTEVGEKGISLSGGQKARLSLARAVYAFSHRRVEGPCK

SEQ ID NO: 20377 - protein, 397 aa, Candida albicans
TRILTLGEEGAAYVIEIISLVNSFLIFVFEVGYYKPGFEITNEKFLDTVNLFSYFTFYYLQPLINKIYATDDVQLTDLPDILGNITCDDTKAKVAKAWEEELKRTKKPGLVSKVWSFVTRRKVNSKPQMFLAIAKAFFDKFAISITLAIIVTGLSFLQPFLLRKFIQFFSTYFYSVEKPPIIIGYFWASVMFLTSVANFIAFNQAFKTQFDLGYEIQSSLTTLIYEKALRLSPQSRKNKPTGDIINHITMDIDIIFWFCWQLGEYLASPLKLAVCLAALYKLFSNATWAGVITAIIVAPLATLVNASMSKNYIQLMKDKDERTSLITEILNSAKSIKFYSWEKPMLARLSHIRNDRELNNIKKIGVVSALAQFLWSCIPFFISCSSPRTGRSDLQCR

SEQ ID NO: 20378 - protein, 487 aa, Candida albicans
  UNSURE (487): Identity of amino acid sequences at the above locations are unknown.
LVVTPPPPFFIYHIEMVKKLQQNTSKSTSLFEIRLKNLDHDVLVLKGNPQEAASALLSGTIVISVIEPISIKKISLRLFSTLKLDGEVTGGASGSSRIINFSKKTYEYIWNSQEFSNYLNNHNNNLSQLSSGTNSPNNRSSTSLSSHNNNHHGAFSKLTRNHSSTSLLGLRSKSSLSLSGLTGGSSTNLVSAFTSSNTNNNNNNNNNKLNHSLSSTQLHSGSTGNTGGSHLLVQGNYEIPFSVILPGDLPESIEGLPGCSNVYRLEAIIDRGKFHSSMIAKKRLRIIRTLTSDAVELSETIAVDNTWPNKVEYSLSCPTKAIAIGSSTPITMTLVPLLKGLQLGDIKIELIEMYSFVGSYPPMKTDERIIAKKKIPKRKKNNNGDEEEEEEEVDMFDQWQIDTIINIPSSLSKCTQDVDLSTNVRVRHKLKFNIGLINPDGHTSELRATLPIQLFISPFVTVRGNNNNSNTGEDNNDRNIDPNDDDX

SEQ ID NO: 20379 - protein, 590 aa, Candida albicans
VNCYYEYMDKVSHQQYLDRLCVLKVDWGNLLSNDEGKVVFGNYGDRTIPMYKLKNLKNGELGFSASGSNTGLNTPSPGSTSGIATPSRPQALRTKFTPIFFKDKDTVNSKILKVPNSGIDGTPFKNVYTSSNHSFLLPKGNYNLPFKVYLPTNIPETVESLPLGTLLYKLQCNIERGRFEKSVNVSKHIRIVRTLNPQNLNLTDSIDVSNTWVGKLQYNVNMTKKGVAIGSTIPINITIIPIVKGLSLKAINGCIVEHYHVQIGNERSPEYERVIGKQDLDAPNSDDLPYDKWEFRTHYKVPEHLKKITQSCELRDNMIVVKHRLRVSIQLRNSGGHVSELRANLPIFVYISANSGHVIGRHYDVDNHHGTFQLDYQKEDILFHHQDRREPSRIPGASATETEEENESGDLDGDDLDREDSAPPMYEKHVFDKIYDMNLPQTPLEQFRSQQATPLHWNNNSSVNVSGYFDIPFSQALENNLKKKQVQTPIFDIDYMSHIPSYTEALDDDDDGAGGEDFAPGYSDSGSESFSVVSGGTTPIKIKLPTNNSTGHFKFSSKNNSLPNTKSNSSSKLDLESSLKLRFFHHSKKK

SEQ ID NO: 20380 - protein, 82 aa, Candida albicans
KVNNLIKKHSTANKLPSSMFQHHLNLALFDIKLKTANKNLLLIKGNEHEIESLPFEGSVKLSLNEDIHIKKITWSLVGELLL

SEQ ID NO: 20381 - protein, 234 aa, Candida albicans
KVQNCNTQSIPIIHGLLETIIITSFKTINPDATEILLNSIFIEIYSTIVSDVDLVKSSLDLFTTILEKRPALLLQTPFFSDTIIPFAIQPLYLHEIFVVKSVTKFWNTAITLKKGNSNDHQQIKDIINSSIQNTTIGVLLIEALLSGFVLAPRSAIEYYFPLFRTLIARMPLEVKNWIRHVLLNSSMGKAPLDSKESETFLNKLLLTRGQRQANDVLRDYWLQVNKLTNFIKYI

SEQ ID NO: 20382 - protein, 147 aa, Candida albicans
CSKVRGQMLDTGLQYHATSSEMFGRFFFFFDVLFSLHDLVFHKLVPLMSDELNIEGVARDIELLYSSSNALEIHELQERLQTYQKSEIGYQLGFKLLENSNKNVKYFGALTITVFLNTHDSSVIFELLFQWTSWVLILNQRAGKPTS

SEQ ID NO: 20383 - protein, 257 aa, Candida albicans
KEEPKKLRKETGNDKIMTEGQATALSFKEMVNECLIRPLKFVVTEPLLDLVCAFVALIYAYLYAFFFAYPYIFSTLYGFGDDKIGLMFIPILIGAGFAVITTYVLEVEYSKLVKRRKPEPEDRLWGAMVGAPFPCIALFILGATSYKHIIWVGPASSGIAFGYGMVLIYYSLNNYIIDTYAKYAASALATKVFLRSAGGAAFPLFVTQMYEGLGLQWASWLLAFVALAMVLIPFTFYKWGKTVRLKLCKEDYFAALI

SEQ ID NO: 20384 - protein, 311 aa, Candida albicans
  UNSURE (228): Identity of amino acid sequences at the above locations are unknown.
LGPVCGPIFGGLLCDYAPTWRWVYWTFLIVAGFFYVVFIVVVPETHHGILLKKRAKKLRKDTGDSRYRSFNELQIRTFAQVAKTSLLRPFVLLSELIVFLVTMYMSVLYGLLYMFFFAYPIVYQEGKGWSASKTGVMFIPIGVGVIASSLAAPFFNKDYNRRAQEYRDRGELPPAELRLIPMMIGCWFVPAGLFAFAWSSYQRLSWAGPCFSGFAVGFGFLLLYNPAXNYIVDSYQHYVASALAAKTFVRSIWGACVPLFTIQMYHRLGDEWATSLMAFISLACCAIPYLFYIFGARIRTFSKYAYAPNMD

SEQ ID NO: 20385 - protein, 312 aa, Candida albicans
NATLNWYQALASGSNTFNPTNSLMEVVYETGRDYNAVNNYIVTIIGQILRGYYKFIPQSGLVVNMLKTLNCTQANHVIYNAPQLISTIPTCSIHDLHPVPNPVFSATMQLAGVYLIVLTFFAFVFSIQIQMYIASKVKGIKYVIFRMMSNQVAYFIISLAFVVLNTAFGLPFNGTFGHAGFLVIWVFSYLLMSAIGSVIEFFVLIVFALKPPMIGFVLLFTVVLNLAPTISPIILCPKFYRYGYAMPLKNFYDLLQVAYFNAWKGHMGRNIGILFAWMVVSNAALPFVMKWLANKKAKAEEQKTNLGRITGQ

SEQ ID NO: 20386 - protein, 174 aa, Candida albicans
KMTPIINGLNPVFGDNLKEILQTPEAKTKGNWKIYDSTEFAQIASKSNRTAEQEIMHQIHHQKYWASLHVMPNASYNYFNAMSQGDANYDPVKNTVHSIYETGRDFNGMTQFVIPSINGVENIWLSRQPKMTFDIVRNVTIDSAVKLKLLAQPIRFEIVDPVPWNDPILIGPFQ

SEQ ID NO: 20387 - protein, 89 aa, Candida albicans
LPSLIPNINYGQKKLNKGSLLFSRKLQNRKNEIAFKYFLNYLIMGVGVLAIFSIYWGSFYGINGRIKNLKMLVVIEDDSHNKWTKPCLR

SEQ ID NO: 20388 - protein, 233 aa, Candida albicans
RVATTGSAFQIIDMRPSTSGVLVAALQIGLLYLVIVSFFSFNFFVDIHRSVALMVKQRNFLLYRVFASIISYFVISLMFGLVTLAFQVDFAVTFGKSGFLVYWMVTFLTMWSVGLANELAAMLILTIYPPMVGFWLIFWVIINITPTFTPIALLPEFYRYGYAMPLHNAFEIYSVIFFNTYKGLIGRSIGIIIAWVVFLTLMAPIVVVYFGSTMSKKAAAAAAAAKKEKEKSK

SEQ ID NO: 20389 - protein, 358 aa, Candida albicans
  UNSURE (346),(347),(350),(353),(354),(356): Identity of amino acid sequences at the above locations are unknown.
KKFLHITMGQRMPSPPSSHITNPWKTPEQTASSSHGHDEVISPETNTYSPDFSNYTRNSSSYRHVDKKSASPPTTTFDNQTFQESNHDDTNNQQYVEADAGDGTKAHEQYLTGFPLFLTISSCIISLFLVALDQTIVSTILTTVGNKFNAFEKIGWLTSGFMLPMACLVPSYGNISIAFGRKWTLVAGIIIFEIGSLISAISNSMSLLIGGRVIQGIGGGSIQAIVMVILTEVVPMNRRSLVFALISVVYSTSSVLGPIIGGALEKITWRWCFYINLPLGGAALVILMLGFHPPKPQGNVREKLLKIDFIGFVLLTSGLVLVLLALTFGGVNYPWNSRMRSIALFXXLVXDGXXKXIF

SEQ ID NO: 20390 - protein, 210 aa, Candida albicans
LSQSSRPVLKIENVSISQTTLAMSTSEMGGPSTIKNLKEKEYYYEADAGDGTHATEQYVTGFRLVLTLFSCIVSLFLVVLDQTIVTTIISDVGNNFKAFDKIGWLTSGYLLPMACLSLLNSKIAVAFGRKNCLLVGILIFEIGSLVAALAKNMPMLIGARVIQGLGGGTIQSMISIILTESVPISKRSLSYALLGITYSCSFLGPIVGAA

SEQ ID NO: 20391 - protein, 179 aa, Candida albicans
  UNSURE (178): Identity of amino acid sequences at the above locations are unknown.
VWTFKYAPNPMILSIFIKNFTIFCACISAFANFAVFIALITYLATYFQVVFNKSAFKSSIAILPMIVSVVVASMLNGPFIRRTSNVKIPMVISGICAPVGAAFLLMLDKDANNSKQIGCQIVIGVSIGLQFQASLLSAQLEVPKDVEGSLIMITVFMSFLKSLGVLWVWFLPDLYTKXV

SEQ ID NO: 20392 - protein, 338 aa, Candida albicans
  UNSURE (311): Identity of amino acid sequences at the above locations are unknown.
FAGRLFFFFASMTSYQSSNNHSSEEDKHLSGDEKTFSPSDIVEKAIVEEKSIGVEKAEILANQWKHTFWFKLLLGFSAFLCGYAYGLDSQTRYVYTAYATASWSEHSLLTTVNAITGVVAAASQPVYARLSDVLGRLELFIVAVLFYVVGTIIECQLPTINAYVAGAVLFQIGYSGIIIMLLFILSDFSSLRWRLFFTLCPSFPFIINTWISGNVTAAVGTRWKWGIGMWAFILPLSCIPLVCCMIHMRWLAGKTEEWRVFKQRKTKFQELGVAGFSKYLFWRLDVIGLLLSTVSLGWLLGPMETWWLVQXNLEKNSFHGAHNPGRCLNPGFPFMGTL

SEQ ID NO: 20393 - protein, 141 aa, Candida albicans
TMVAAQSQAKKSERAVVISCRNVIRSLGGAVGLAVASLIITNSLLKEITKQENRQDISSTSSVPTGYLMYLKTHVYSKVDTTQLTADQVLIVRQMYMQAIRNFFYLTIPLLALCLISSLFVKDKGLQCIDEEPEKDEKELQ

SEQ ID NO: 20394 - protein, 125 aa, Candida albicans
TYRIGYAVGSSVAGAIWSQMLYSRLVKYLGDSTLATSVYTDPYTFIAQYVWGTPEREAAVKAYGEVQRVLMSVCIAFVAPMIVSALFMRDHKLTNEQSLEDVEKQEEKDSLANFFGNFKKKRVAV

SEQ ID NO: 20395 - protein, 497 aa, Candida albicans
GSSDEDDLELGRRRSGTMPTVISPQEDFFNLKTDYNLESKSLFKNSLPLILTFILEHIFSIVCLVVVGKLGTKQLGAVSLATMTSTITFAIFEGTATALDTLCPQAYGAGNYELMSIFVQRCNIFSMILFLPCALFWWFSGLILKYVIDDPEVVHLTQEFLRYLILGAPGYILFENSKRFLQAQGIFEAGTGILFVSAPINIGLSWFLVWNETYGIGYIGAPIATGINFWLMMILLVLYVRYIDGGKCWFGLASMEELFSNWNQIIHLAIPGIVMMESEYMAYEIMTLFASYFGTVQLAAQSAVSSIASLTYMVPFSVGIAATTRIANFIGGQNMVGAILATRVAMVAAVIVSTINCLALFSFRYEIARIFSDDPEVISLIVDLLNPLVSVLQIFDGIASVNSGILRAQGSQKIGGYINFIAYYAFALPLAMVLSKIVGLQVFGLWIGVGSGMAVIALSETAVIMFSNWDDILMKAGIMNEFGFDDSDDDGEDDDIF

SEQ ID NO: 20396 - protein, 357 aa, Candida albicans
LFNFLVVYFYFHSFKTHTPTNISIMSSSHPDRTHQFTHSNTKRRASIVYGSVGKGGLYLPSDFIPTKDNGHNNTFDNEDEEADNNNETQPLLPDSFGNSPSTLLYNKKKIRRKLSVINHELIEEERELLEDNHIPIPETNGSTNAIQDEAVAQEEEDQEDNIIRDTFENAIINKEIQSTTSTIELKNLIKSSIPLVLTFLLQNSLSTVSVFSVGHLGATELAAVSMGAMTANITGYATIQGIATALDTLCPQAFGAKKYKLVGSYLQKCTALISVIMLPIFIIWIFFGYDLICVILPDKETAKLSAVYLKYLTFGMPAYILFECGKRFLLAQRIYHISTYVLLIAAPSNLIMNLLFV

SEQ ID NO: 20397 - protein, 239 aa, Candida albicans
RFSIKDAFHDWKKLIVLAIPGLIMLEAEFLAFEILTLMASYLGTIALAAQSVGTTMAALTYQVPFAIGIASSTRIANFLGAGLGDAAKITTKVALLFGLFISVFNFLVLFIFQTQIAKAFTNDEKVISAVTNVMWLIALMQISDAMNANSAGCLRGQGQTKIGGIVNLFSYYVVGLPLSVYLSFYSPWKGSLHGLWIGSTVALTIIGSVQSYYALTVDFNKLCDDARKRTNTENHHNHV

SEQ ID NO: 20398 - protein, 341 aa, Candida albicans
NNSITPIYISSISKYQVNVRTSMKMKLYHTFNNGTQSIASVGHDKIPKSFALPVTTAATGVTSGGVGVVTGGGTNGVASPRLARSISLSSLISRKSYSINDIIEIHQQEIDPEPKTTILNEIKVIIKYSLPLIVTFLLQYSLTVASVFSVGRLGSTELAAVSLSSMTANISGYAIIQGVSTCLDTLCAQAFGRKDYNSVGVHFIRCNYLLLLLYIPMAIFWVFGAEPLLVTIIGQDSIAMCQLAGKYLRILTIGLPGFILFENAKHFLQTQGIFHASTLVLIICAPLNAFLNYLLVWNKSIGLGFIGAPISVVITNWIMCFMLYGYIFCIDVFTTRRKDHA

SEQ ID NO: 20399 - protein, 483 aa, Candida albicans
KLFLTLTMNTEETLLITPVDNYDAIVNDTKYYDSTPKLELKHLTRSSFPLVVSFVLQYVFSITSVYAAGRLGAKELAACSLAICTFNITGLAVFQGMATSLDTFCSQAYGSGNKKMVGVYFQRATLLMLATMVPLMLVWWYSGSILNQLVPDPELVSMAQLFLRIHAFGVPGLILFESGKRFLQAQHLFQASTYVLVVALPFNLLLNWLLVWNPNTGMGYTGIPLSIGITYWVISLLMFGYVIFIDGIECWGGIDWEKASSNWKPMLSLAVPGVIMVISDFLAFEILTIFASRFGTEALAAQSIVSNVATLCFQVPFAFAVAISTRMGHFIGDGNIASAKILNDLTVIIGGSIGLLSFCLFYFGRHVLGEFFTSDKMVLEISSKLLILAGINQISDSLNVVGTGVLRGQGRQRIGSILNIISYYFLAIPLGYVLAFKFGMEMSGLWIGLTIGVFVLAVTQCTSICLSNWEKILEHSHRIHDSV

SEQ ID NO: 20400 - protein, 530 aa, Candida albicans
NKTQVVRLFLFFLFGQTSSKMEEIEKEKNKDLLEDFTTTDNRDVLEPELLEKTSDPYLVIFDGSDDKEDASRLSRIHKWTIVGIISIGSVCVTCISSSVALATPQIMEHLHVSHEVAILNISFFILGLGTGGCFLSPISEFHGRRIVYIGGLTTMIAFEFLTAFTSNIGAMVFGRFMSGFCGLSYMSVASGSFADLFKARKKEGKDANKELSLALILYSVAPFLGPSLGSLISGFINTYLYYRWTFYVFIIWSGVLLLAVVLFVPETYEPVNLQRKAKRLRKTTGDNRYYAAADKQTTSLYESVLTSSKRPILLLLRDNMTALLNLYTGFTLAVVYLFFVAFPYIFSTVYHFTISEQGMSFLGLVVGMVSTCLISPYFIDKGYVALLRKNNGVAKPEFRFIPLMVGAFVVPIGLFIIAWTSYSHIHWIAPIIGSAVYGSGTILVFNSIFAYTVEAYRLYAASAMATNSLTRSVLSCIFPLFGLQMYKGLGIQWATTLLALFACLMIPIPFLFFKYGEYLRSRSPYAWSVD

SEQ ID NO: 20401 - protein, 123 aa, Candida albicans
PRGLFNEVVVLIILTFGKQQLIAPWMVFNIVANVSTTFAPFVLTPGFFRFGYALPMYNAYEAVKVVFFDTWKGHLGRNLGVLIIWIVVGNVSLLFVSHWSTQRAKKIALAEKQKKKEQQQVDK

SEQ ID NO: 20402 - protein, 396 aa, Candida albicans
QKLPGNWETTTTTPRDRITNSDSVDPLSTESAQFYDAHDALEADGVYATAVQKVQSQRLETEHRQDNVPGTSTTTTVPQGDVKGEKHEDQHDTQSLTIKERDHEYFKMIPQFFFVYLQVFCIFLGFLSMYWGSIYHRDQRYRNVGYLVVNEDSQFQVPNGSGSASSSTVEPYLGNAMLNMLTNNKTIENLGDFQIVNLTDFTQLAKKHNNTILEEVQRQVHHQKYWGAIYIAPNSTQNIYQGFSTGNASYMQNVNQSITVVYETGRHFSALSQYLNRNLNLVSEAWIRDYASSQVYQPILGQLNSTQREYLLSNNQTIAIFTTLPTFNFIDQRPSPSPAVLGPSEIQLIYCLIISFYSYNFSKDIYAYMRKKIKYRSYLFYKFLISQLHAFVLALV

SEQ ID NO: 20403 - protein, 96 aa, Candida albicans
ISAVLHFNPFGKQHVVPEDDERHVGDLGNISTDVNGVAKVPKQDLLIKLIGTDSILGRTIVVHAGTDDYGKGGFEDSKTTGHAGARPACGVIGLTQ

SEQ ID NO: 20404 - protein, 159 aa, Candida albicans
HIKPFLFFSVAVVRGDSKVQGTVHFEQESESAPTTISWEIEGNDPNALRGFHIHQFGDNTNGCTSAGPHFNPFGKQHGAPEDDERHVGDLCNISTDGNGVAKGTKQDLLIKLIGKDSILGRTIVVHAGTDDYGKGGFEDSKTTGHAGARPACGVIGLTQ

SEQ ID NO: 20405 - protein, 814 aa, Candida albicans
CLLFILFHPLLNRNNNIMGKPKKHMSFTATNYVPTDDQSPDSSNLRNHANGTKNSTSSLDQLINSGTFIDHRKSFDWANAHSSPTNRRRKKSNGSFRNQKSNKDPPSLPLTNRNLQTLIRRSSTIEDPISPTAVAIDIDKFTNEQRLFAKSNTWQDHYEDRDDEQYSYSEFGESNPSSEHSSDSTSLDDVCFPDFREDVKTTSAWPDLHVLEEFIKEELEEVQTDLEPTVNFGGNVVHSENEDATESTPLIDSFKVNEVESLGLENNPFQIRPTPIQPWERSQQNIPPILKDVNKGKVDKEICRFTYFREDLSKTIHSPTMLGLIEDNSKIYDSLEDFFPPTRSKPPSIHMKPDSVSSTNLPPLNKSRPETPTPSSVNDSLSRREPFWLDVFDPTEEEMKVLSKTFGIHPLTTEDIFLGEAREKVELFKSYYFVCFTSFDVVYEKRRQRAKEQEKKLNKLQDMYENGSDNGSTLESKSPFKLLKSLFSRKRRLSSYLEKPTSTSIKSQGKKIRDGELLPLNMYIIVFKTGVITFHFSATPHPINVRRRARMLKDYLSVTSDWICYALIDDITDSFAPMIETIETEVNAIEDAILKMHSGESDSEDESEEESDHPENVFVFRKRSKSMVDHKSGPRLAKSVSSSSGTNSSRILGWKRKGDMLRRIGECRKRVMSVMRLLSSKADVIKAFSKRFNELEGSLLEIGMYLGDIQDHIVTMLQALAHYEKLLARFHSNYLAQINIDMTKVNNDTNDVLGKITILGTIVLPINVVTGLWGMNCLVPGQDYEGLAWFWGIVGCMALFSLVAYNYARRVTGL

SEQ ID NO: 20406 - protein, 485 aa, Candida albicans
TVVVVSKTMITTTSISSVILTILKPLVFIYQFIYRVYWSGLNQRNILQLILNFCINFSPVFIWLLIFKNAGLIPHEIRPKIHVKLAYHLDQYIFETIIGGIVNILGLASLAWLLYRFVYQLKSSNNNSNRNNHHQSQISGEYPPSNTNDIYSLYKIPQNYELDIDNDSSSSNSSNNSDIELESFPKELLKPSYNQLPPINFQDNDDQIQDSQLDNNRVHYGNSENTRFAPMVFIPQLTLVEVGQMAQSINNKILNHIQPKNSNSGFNYNYSPINSWDFCPSLLLATSWFLLNFVHYLREPIRLWQDYLAWTSYVLGHITVPIITAVWLYVFHAPGSLKAYSFALGLQNICGVLTHLLFPNAAPWFIHMNGENANADYDTPGYAAGLIRVDIALGTHLTSNGFHASPIVFGALPSLHSAMAVMTFFFVGYYSRWYFIKFLAFMFVMIQWWATIYLDHHWRLDLLAGLIYACIWFTIIYKLVIKYQQ

SEQ ID NO: 20407 - protein, 633 aa, Candida albicans
QSSVTTRDSIIITMSGKKKENSFSNPDNAELQANAPSTPQNDSDSSVIVQPNIHNDIENQPTAEQKGFKESDAGDGTKKEDHYLHGVQLILCFLSLFLCLFLFALDQTIVVTILTTVGTKFDAFSKVGWLSSGFLLTMAVFIQFFGKLSIIIGRKWAMVIAIILFEAGSLMCALANDMNVLIGGRVLAGIGGSGINSLVFVIGSEVVPITRRPLALSIFSITFAVASVVGPLIGGAFTSKVTWRWAFYINLPIGGFATLVFLYAFRPPRPKVNVKQQLKQFDYFGTFLLIAGSVILLLAITFGTSDFPWDSAAVISCFVLGPVLLIAFVVWNFGFSKNQVISTEIVKVPQIIASTLAISGIFSAFIMFMIYGAIYFQVVKDASPLSAGLHLLPTIIAVVLSSMLSGLLVQKFKFVKPYNVISGILGPIGCGLITLLEVDSNFSQQVGLLIILGVLAGLQMQPSFLSAQIKAPKTPSGMIMTTTFINFSRSILSAFGAVLADAVYTTSLKNIYSKAVKKVTNPVILQDLQKFSLSQLTSSTALLKTLHPETEHFVKTQIMNAIRNVFYMAIGFSAITFFAAFFVTNERLPKNVEKPEEQSNEKETKESDSSASDVSQPKETEEDEVRNEEPERI

SEQ ID NO: 20408 - protein, 440 aa, Candida albicans
IQRTQTRNLILTKLESRVEDNTNNYSNDNHEHEVECQDTISVIPDTNIEIAQHGKEFDTIDPELITWNGPDDTEDPRNWPINKKIFLLGFVSLYALVAPMSSSMLSPAMTFIAEDFHISSPIIKSMVVSIQILAWAFGPLIIAPLSEHDYIGRKLVLDVSCWMSLFFNLGCAFSQTTAQMMVCRFIGGLFGCVPMNVCAGVISDMFDAQSRNAALAGYSLVPLLGPVIAPVISGFIVDHKQWRWTFYVLCIFNGFVDITDTFLFKETYSPTLLKRKAKKLREQTGNVNIHTIYEIADGETKLGKIWLCMVRPIKLLFTHLMIVGLGSFMAFTYGFMYLMIVTFPEIFGNQYGYSKSVTGLMYIPMGIGFIIGVIFWTYMVGNVYERLTSRNNGVAKPEFRLPCLIASSIFIPVGLIWFGWSAQKKLHWLISYPRDWTDPR

SEQ ID NO: 20409 - protein, 421 aa, Candida albicans
ADMMQIYHIGRTPATLTTSLFVFGFASGPVIYGPLSELFGSKLVMVPSCLGYVCFSFAVATAKDIQTIMICRFFAGFIGAAPLVVAPAVMADMFNNRYRGTAIAIFSMLLFGGPMLAPILGAFTVKNSALGWRWTSYFCGIIGSLALFMNTFLLQETHHPLILTRRAEELRRRTGNWGIYAPHEELKLSMKEIVENNIARPLKMLFTEPILFLVSLYNAFIYGMLYLFLTAIPLIFLGEYHFVQGVAELPYLAMLIGILIGGGMIMLFEKRYIKAMEDNGGKIIPEKRLEPMMVGGFTFVIGIFWLGWTGNYPQHVHWIVPVIGAAFVGNGLMLIFLPCFNYIIDCYLLYAATALAGNTFIRSAFGAVFPLFARQMFTNLTIKWASTLLGCIGILLLPMPFVFYYYGKSLRHKSKFAFVLE

SEQ ID NO: 20410 - protein, 195 aa, Candida albicans
IDRTMNNNTNSNHNDIAPEATITQNTTTSVSNDELQHITNNNNVNVQSYVGPTDSVESSSNTADEENEINSFNAQNVKDYEANVGGELPPDDELSRIESNTELSRRATRSIMNTESLLRTASQSSKPLPPMGGGKEYPPMLGSRDPYVVAFDGPDDPDHPHNYPTWKKILYCASVGLAALSVSMGSAMLSQSSAD

SEQ ID NO: 20411 - protein, 566 aa, Candida albicans
LSTMPASGSISSEEPLMTLKPYEGIPTIEGDEQYLQNYSTAQAGENELLRIESNVQASKALSRIISDSDPVLQRSLLLNEPLPLMGGGRPYPPLLGSRDPYAVTFDGPDDAGFPQNFPFWKKMVYSLGPLFTALSVSLGSAMFSQASPEIMAIYHIGVTPAALTTALFVFGFASGPVIYGPLSELFGRKIIMVISSFLYVCFSFAVATAKDIQTIMICRFFSGFVGSAAFVVSPAIFSDLFLTEQRGTAISTFAGVLFGGPMLAPIFGGFTVKNSSLGWRWTAYFCGIVACLGLVLNVFLLDETHHPIILVKRAEELRRRTGNWGIYAPHEELTLSLKEIVENNIARPLKMLFTESILFLVSIYNGFIYAMLYCLLTAMPLIFQEGYGFRRGVAELPYLAMLLGVFIGIAALILFEQRYLKAMEKNNGKPIPEERLPPVFIGGIFFIIGIVILTVAGDFPKKVHFMVPTVGAGFVGFALMLIFLPTMNYVINCYLFVAASALAANTFLRSAMAAVFPLFSHQMCVNLTNKYAGTILAGLGVLLLPVPIAFRVYGKKIRENSKYAYK

SEQ ID NO: 20412 - protein, 303 aa, Candida albicans
NYKDRTHSLKDIDFSVATGQLSCVVGKVGSGKTSLLYALLGQLITTQGKNAELPPLIEIRGTVAYCAQQPWIMNASVKENIVFGYKFDKDFYEETIEACQLLPDLAILPDGDETQVGEKGVSLSGGQKARLALARAVYARADVYLLDDILSAVDSNVGRNIIEKVLSKGGLLGSKTIILCTNSISVLKFADNITLIEDGCIIETTTYAETNADSHPKLFELIKNFSKDTSPIPSDLATVSPSHVHSYRKASIESFHWDPLKKLLPNLRTGLTEDVSQKGKVKWEVYLAYIRACSIYGGALWFI

SEQ ID NO: 20413 - protein, 673 aa, Candida albicans
  UNSURE (31),(44): Identity of amino acid sequences at the above locations are unknown.
VVMFDEFAETNMFSKERPRAYDNSIYSFIVXDATFVWSEETQQXQYTDEESEVQEVPASNVALKHINFSARKGELACIVGKVGSGKSTLIKAILGDVPIKILSYSDDSTNPTPSVETFGSIAYCPQNPWILNGTVKENILFGHKYDAEFYQKTIDACELISDFKNLPDGDQTVVGEKGISLSGGQKARISLARSVYTRADIYLLDDILSAVDAHVGKNIIKKVLSNEGLIGNRCRILATNSVPVLHEANDIYLIAGGAFVEHGKFKEVMKRNGDLAKLIKEYGRKKDEPTEEETTEASTEPKEEDHSNGKSDTAVHDELDTDELVDEIVDYVGEQNRGVVEQAILRRASVVSYGHNYENDEADNGQIRKTRHEQEESRKGTVPWDIFKQYIIACDYKYFSFYVAATFSVVLISAGEKYLLSYWSQLNSEQNDTVEPVFFLGTYATLGVVSGFLTYMGALVIWSYCIVKGSTYFHNKMAESVLRSPMSFFDTTPIGRILNRFTEDIGKIDMNLPWTIISFITTLLNGFVTFGVILSFLPLMLVVIVSLLFVYNYFRIRFVPTTRELKRLESIAKSPVLATIQESINGVETIKAFHQRERFVYKSKKLIDEKTLIGVVQQNCNRWLSMRLQTISSSIMFFTALLAVVTLGGKHPILPSILGFVMTSSPRVEIRLG

SEQ ID NO: 20414 - protein, 68 aa, Candida albicans
KHYTGRAFRSQFKDKTIITIAHRLETVMDSDKIVSLDKGELIEFDTPQNLLNKKDGVFYSLCKQGGYI

SEQ ID NO: 20415 - protein, 162 aa, Candida albicans
VLTLILVWKVLELAHLKEHVAKMETDPTEEEKKASKNPDELSKKVGLDAQIEEGGSNLSSGQKQLLCLARALLNETSKILVLDEATAAVDFQTDKIIQETIRTEFKDKTILTIAHRIDTIMDSDKILVLDSGKVAEFDSPQNLLKNKDSIFYSLAKEGGYID

SEQ ID NO: 20416 - protein, 208 aa, Candida albicans
LISHIHRYTTTKMAPVVQQPAPSFKKTAVVDGVFEEVTLEQYKGKWVLLAFIPLAFTFVCPSEIIAYSEAVKKFAEKDAQVLFASTDSEYTWLAWTNVARKDGGIGKVDFPVLADTNHSLSRDYGVLIEEEGVALRGIFLIDPKGVLRQITINDLPVGRSVEESLRLLEAFQFTEKYGEVCPANWHPGDETIKPSPEASKEYFNKVNK

SEQ ID NO: 20417 - protein, 83 aa, Candida albicans
  UNSURE (45): Identity of amino acid sequences at the above locations are unknown.
QRIRIDILIMSEVSKKYHFDVTMSCSGCSGAIERVLKRLDGVSSXDVSLDKQIVDVITTQHYETIYNTIAKTAKKINGGKEIS

SEQ ID NO: 20418 - protein, 504 aa, Candida albicans
MLSTTQSVTEPTEVTLKKVEDIEKENDEETPYSIFTSYDRLVLIVILSLIGFWSTISSPIYFPALPTLTSYFHTSSSIMNISVVAYLIFQGIAPTISSNLADTFGRRPVILASIIVFCASCVAISQTNVYWLLAVLRCIQAAGIAAVISISSGVAGDVCTRANRGSMVGAVAGLQLVGNGIGGLVGAALISSFNSWRSIFIFLTIGGGVTFILAIFILPETSRKLVGNGSVVPKNILNKSPYIYLPHFKKRMNNDITTIVPATRFDLLGPLKIFFQKNVFCTLLPVGIHFAAWTMVLSSLSTELESRCHYSVMHVGSIYLPQGIACIGGYLVVGKSLDWYYRYRKTISDLEVECLPLDERPQFNIVATRLTISVVHALLMIIGLVIFGWCIQYKRHIISIIISTILVSFSASVFIAICTTMLVDLYPNNGSGSTSCLNLMRCWLAALGAGVLDSMINAMNVGGTYTVVAGFCILFDLALIYVLHNAKKKFSNSGPTTTKSPPKQ

SEQ ID NO: 20419 - protein, 397 aa, Candida albicans
TEKKAPYTLCESTDKLLLIIVLSLVGFWSAISSPIYFPALPTLTKYFNTTPSVMNISVVAYLIFQGIAPTISSNLADTFGRRPVILGSIIVFCAVCIAISQTNVYWLLALLRCFQAAGIAPVFAISSGVAGDICTPANRGGMVGAVSGLQLAGNGIGGLVGAALISGFHTWRAIFIFLAIGGGVTFIFAFLVLAETSRRIVGNGSIRPKNVLNKAVLIYLPHFKNKITNDYSTLQPKGPFDILGPFKIFFQKEVFCTLLPLGMHFAAWTVSLTSLSTELESAKYNYSVMKVGLVYLPQGIACFIGSLITGRCLNWYYRYRKNLYDKQMNDVPLNDRPPFNLVASRLTLTIVPLAMMVIGLSAFGWCLEYKKPIISIIISTILISFSASVMMSICTTM

SEQ ID NO: 20420 - protein, 120 aa, Candida albicans
PYQPDPNLQNYFNQHQSPKLVNIFFLFLNVKYFHQPSVMNDLDFVVSPVQTKVEINDQNNEDFIPGTLNIYSLEVDSEDENVSHYDASSRPKVKTKGNIILFPQPSNSCNDPLNWGLLHL

SEQ ID NO: 20421 - protein, 266 aa, Candida albicans
  UNSURE (266): Identity of amino acid sequences at the above locations are unknown.
FLILWCFYFLLTNYFKFLSPVAAGYITANPHLGWRWCFYVQIIIYAVLFIFMFFVLEDTTFTRDSKKEDEFEEHILQQVQSMRSKDNVDVILSSSASVKTEENESVDESTIPKKTYWERMKLIHTEYGDRRSWLLIFVRPAFLAYFPAIIWSSCAYGAQMMWLSLMGNTQTLFYASEPYNFTADKVGLTNLAPFVGVVLGMLYGGRFVDWFSLQKAKRNFGILDPEHKLWTMIVPLLFNAAGLIAYGIRAYYGAHWGISVIIGQGX

SEQ ID NO: 20422 - protein, 204 aa, Candida albicans
MFDKEINEIPEYEMVTGTVQLVDVTGTLEVEKNGDKSNIILQPPPSKNINDPLRWSKRKRRIQFFLLFIWSFLQSSTSNFTGPLYDAFVEALDVTYQDISNTAALCFTGLGLGVIIIQPCAAKYGKRVVYLTCTLIAIIGCIVGGTGKNLALLYIFNFLSGLGASPVDSIAEVSANDLHFQHERSTALSVIIMALYFGSVRKTF

SEQ ID NO: 20423 - protein, 595 aa, Candida albicans
KKFPFFFLFFEMAFDTTVPQEYYDENFIPGTTNILTGKTTIDESSSITTQKSLKRDPKTGLVLMPQPTSSPNDPLNWSPFRKFAQLTLLSFITALTAATSNDAGATQDSLNKIYGISYDSMNTGAGVLFIFIGWSCMFFAPASSLYGRRITYIICLLAGTLGCVWFALSKRTADTIWSQAFVGMSEACAEAQVQQSLTDLFFAHQLGTVLTIYISATSIGTFLGPLIAQYIAQAHTFRRVGWWGAIICGATLIVIIFGCEETVFDRQLYTKVLESENVTQIPDPSEEKKQDNPLTNNIIPHEKKNSMEQELSHEYITANNNEHDVVPIDPETLNEKKKSYWQRIAIITPAPYLQGLGFKQYLERFIIYFKIFTLPAVWFSGLLWGLQDTYMTFFLTTQDTYFYNPPWNKSNAGVAIMNVATLIGAVIGCIVSGLFSDYHVIWLAKRNNGIMEAEYRLYLLVITLIISPVGLIMFGVGAAREWPWQVIYVGLGFIGFGWGSIGDTSMSYLMDAYPDIVIQGMVGVSIINNTLACIFTFACSYWLDGSGTQNTYIALSIIDFATIALVFPFLYYGKTFRRKTKRLYVSMVELTQGMG

SEQ ID NO: 20424 - protein, 450 aa, Candida albicans
CGTFQAPGVMIRKITYFICIFLGLLGAVWFALVKSTSDSIWSQLFVGISESCAEAQVQLSLSELYFAHNLGSVLTSYIVATSVGTYLGPLIAAFIVQNIGFRWVGWIAAIISGALLFVIVFCLDETYFDRAKFTKPFITGIAPFDSSYSNGKLDSKNSIPEKQNSVNIELNVESKEVEQSDDDIANEGENDPPISYWKRTAMITPATNLKSTGFKQYINQLKLLLKVFLYPPVIYSGFCWGIQNALLTFYLTVEDDQYYDPPYSYGNIAVGLMNIPCLIGAIIGCFFAGTLSDYFTIYLAKRNKGIQEAEYRLWCLLPPAIIAPVGLILFAVGTNQMWSWVPTYIGLGFIGFGYGCAGDVSMSYLMDSYPNAVIETMTVVAVINNCIGCVFTFACSPFINALGNTKTFIILAVIEFVIMASACFFIYYGKRIRIWTKDWYLEFCEARDGL

SEQ ID NO: 20425 - protein, 442 aa, Candida albicans
QHIKMVNQVVENNDYEMVPGTVHLIDINGNLDVQKNGDIILQPQPTNNPNDPLTWSKLKRLIQFSLVWIWGLFVAVAINWVGPVFGVWEKDLKTTIGDLSNAVAVGFLFLGVGVLLVQPTTLKLGKRFIYIAGSIFTIISLAVGSQATEVGSIFAFKALVGLGASPCDSVVELSATDLFFQHERSTAISSLILALYAGSFVGPIIAGYITDSIGWKWCFYVQIIIYLTFLIIQIFFQQETTFRRSLSDETLEEEILQQIKSTEINNEKQIISEPLAKEIVDEELGSSSIESYKKKTYFQKMNIIHTDQNDSRSWLCIFYRPFFVLYYPAFIFGGIVYGSQMMWLLLTSTTQTLIYGAEPYNFSANGIGLTNLGCLVGSILGTFYGGKFVDWLSIKLAKKNNGILEPEYRLWAMIIPTILNAGGYWRTIFFVPTKHHGLYQSF

SEQ ID NO: 20426 - protein, 145 aa, Candida albicans
VSIMGHDYSNDTKCRWILAYYLLCANKASWALSVVLGQGALGFAMSSSGSICITYAIDSYPKVASEGIVLMLFIRNMMGMGFSYAILPWINRNGLVVVTWLMFMLSIIINGSFIVMLLFGKRFRRWTAAHYEKVSEPRYGEFFKR

SEQ ID NO: 20427 - protein, 264 aa, Candida albicans
LVDGSIKTICIVLLSFSIIWVLDICISSGMVDCHFRNHWRNFRHPPYGYNQQTVGLFYISPFIGGILGSLTCGLLSDRIVRYLVSKNKGVYEPEFRLVMIIPSTLFIAIGLMGYGWSSQVHNPWVAPVIFFGAMSFGSSMASTTAITFAVDSYKVFAAESLVSFNFLKNLLGFCFSLFNNKYADREGYRAAYVTYGGIQIFVSLFAIPLYIYGKKLRRWTDEKEFMRSLYHEDNVPPSVAPSKTRLSEEFLHSDTTTNENTITK

SEQ ID NO: 20428 - protein, 398 aa, Candida albicans
PRKLLTEVNESMKKSATGIILSPQPHDSPNDPLNWPVWKRDICLLIIGFQSFIGGGMSPLLAAGMNTLVTEFDRPLTTISYLVGGFMLSLGCGSVIASPTAVLFGKRLVYIGGIFIFMMGAIWGGAAKDFGNLMGARVITGFGASPTECLPSSTIAEIYFAHERAYRVGLYTMLMLGGKNIIPLLSGLVFQSLDRHWLFWILAMFLGFNLIATFLFVPDTFWDRNPTPSKRSLEETKMAQSVATYHPPSQRPNAFALHRPSQMNITDVHSLSSSINESAEKQQEVGQTPVGITEPNDISQQQQQQATPQTKNSYLKEIRLYQGRFTKDSWWMVALRPFVLYCYPSVLFGSLTYALAVVWLIVISETIGEILDIHLMVITSRRLGYFIFRHLLVGFWVL

SEQ ID NO: 20429 - protein, 83 aa, Candida albicans
QHIKMVNQVVENNDYEMVPGTVHLIDINGNLDVQKNGDIILQPQPTNNPNDPLTWSKLKRLIQFSLVWIWGCLHHGDGHPHNF

SEQ ID NO: 20430 - protein, 168 aa, Candida albicans
SWLALYLRPTSARPSSPVVKTHHVSKFIRPNEKIFSRSHSNYLAQLQVESFNSNNKITEMFSKITLIGTMLVPLNLVTGLFGMNVRVPGEGGKNLGWFFGIVGVLIFIIIGSFIFAQWWLKKLNNSIEGQNNGNRPIFNHSSRRSIRSLGLKKHGGNKSIISFPNKYE

SEQ ID NO: 20431 - protein, 785 aa, Candida albicans
INIIKSISPLLFFFFPAMSDSESYYQNSTTNQPILRSDEVLDDHRNQITNDCAISDSEDELELKPELESEVAKSEKQQQQQQQHHQEITSDNAKPLTRKSGSSIKKKSNLTDKDRITNPMSLSGGDDTINSGHKNRNYNMSSLRKDFYLKDNTDDNSTNNHTHLAIPIPIPIPTPIITNANKSRRKSQLENLPPLIKKKTIGRNNSNNFENDLVSPMTKMKTNDSEDITNTTSTTANHMKLGIGATTLGVGTGTTATATATATAGGGGRRPSRSSIDSEADSHASRSSQETEEDACFPMVGDHIRVNGIDFDEIDEFIREEREEAYLQKQMIAKNILRIDEFQNLSKTNTTSGASRHPYHHHSNNNKKNNGGDGSSGSSMAALKYTPKNILKKTLSRFEFTHENSSSSEEIYELKTKQQPPYKYDDQLSLTSSTSSTSGSGSGSGQVKFGGARISDGINGGSLPDRFSLFHSESEETIHAPDIPSLVSPGQSVRDLFRNGEETWWLDCTCPTDSEMKMLAKAFGIHPLTAEDIRMQETREKVELFKSYYFVCFHTFEADKESEDYLEPINVYIVVFHDGILTFHFSPISHPANVRRRVRQLRDYVDVSADWLCYALIDEITDGFAPVIHGIEYEADAIEDAVFTARDTDFSSMLQRIGESRRKVMTLMRLLSGKADVIKMFAKRCQEEANSSSGYYQRQYNLQQQRQQQAPPPPPPNPIITSPINSTLNLNSLGTSTGGGVRVRRINFGPHPTGNNTNTNTNTTGSPSPPQLQTHGITNKSFPIP

SEQ ID NO: 20432 - protein, 309 aa, Candida albicans
ILLYNNRSRGKSAFSMGFFGTSKEEESQLRQAVLTTSETRQSYSSNTESSVYETADEMDSQVSPNIDITDHEKDNQGINTDETNNNHHTAATNVSPQGDDDSTVQGHEYSANPISDSNDDSDSSVPKNFSGIDGDNEEEEEEENRLNREYTIERIKSHKSLEAAAEEQIKEEESFIHPHSSSSTTFDKEKIYTVDELLYDGPDDKDNPHNWPKWKKWMITYTAAILCLVCSLGSSMYTGSVPEIMKRFGASQELCLAGLTFYLLGLAFGPALSGPLSEVFGRKPLYMFSLPIAMLFTTLHHVDGCPRLL

SEQ ID NO: 20433 - protein, 360 aa, Candida albicans
GPKRWCGLRGKIKGWPRGCGWGVIEFYRGQCAHLVSFFPETYKPIILARKAQKRGMKVEVPKLNIAFVKKVIKFNLFMPLKLLIEEPIVLVLSVYISFVFAVLFGFFEAFPVIFRGVHHMDLGISGLPFISVGIGLFLGVVTYVILDKTIFFPKNPDGSRGKRDADGNFIWGVPEKKLLNGKIGAPFLPIALFWLGWSGRSDSIHWMAPTASGVFFGYGLILVFFSVVLYFSMSFPPIYVASAIAANNLLRYTLASVFPLFTVQCFENLGIGWAGSLFAFIALAMVPVPYVFGYFGPHLRARSKFGYAAYFKKLEEQKELQAAADAKKKNTNRTQEQSVNSSAVELEMSSESEKAVAEKV

SEQ ID NO: 20434 - protein, 396 aa, Candida albicans
ITGGARICRAWQGIGFALLIPCGMGILGNIYPNGERKNLVFGCVGANGPAGAFFGAFIAALIAQLWWWPWIFWLLSIGCVVLTIISMIYIPPITHHKLESYSEFFKRIDPLGTLTGIIGLILFNFVWTQGPVVGWNTAYIIALLIIAVLLIVAFFIIELYIAKYPLVPKSVFNLKIGMVLACISCGWGSFGIWQYYYWNIILNLRKYTPIAGSLTYVPFLVMGIIAAIASSIIISHTKPSYIISFSTICFMVGCLMLSVTPIQQSYFRLTLGQMFILCWAMDMSFPAASIILSDYLPNHHQGMAGSLVSTVINYSVSLFLGMSSCVETEIKLSTHNVLLSYRSGLYFGIGVASLGIFCSLISIFVQRNDGKGTNALLVDLDEEIIRESTEDVMEKK

SEQ ID NO: 20435 - protein, 142 aa, Candida albicans
HSSILNFFFLVLSKNSLIVPHPYLFEFSQTIAYTHTASLTMAVSLDPRPTIFTSSHHEIIVVTLICLAQFFTQAGITLSLSTMNIILKSFDTIDSAKQVWFMGSYALTVGTFILISGKLGDLLGLKLIFVIGWSFHHGAARN

SEQ ID NO: 20436 - protein, 549 aa, Candida albicans
FDKTFFSFFKTTKQTSFNCIHSIFNNHFIMSDCTSSNSVSVEEFNPDPVNELEKKESNVTVTTVSQLPEPNYENISVIREILFMFFMCMSQLLTQAAVSQTMNTQLKIADTYSIQDDPGEMSWFAASFSMTAGTFILVSGRLGDMYGYKLLYIIGYLWFGVFSLLCGFAGLTKSNVFFTTMRGLQGIGPALMMPNSQALIASFYPESFKKNVCLALFGAIAPSGFVVGALFSGLLADLAKWQWTFWLCGIVSIGLAALAFFIIPKKIGLKSSGKFDFWGSLFGVSGLVLINFAFNQGPNIGWHVPYVYVLLIVGFLCIVAFHFVEERIQYPLVPKEALQGDTGFILGCIAAGWSCFGVWLFYTLRWSLVVDNDNAVMSGVKMIPCGPMGVVAAIGGAILLMKVPSAVVMFLAMMAFFIGIVIMGTRPVGQIYWAQKFVSLLIQPIGMDMSFPAACILLSSSLPRHQQGIAGSLVSTFVNYSISIGLGFAGTVEYYTTKNKEPNLSTSIFGMRNAFTMGNGLAGVGVVLSSIFMLLQIINRKKLNPSQDV

SEQ ID NO: 20437 - protein, 517 aa, Candida albicans
  UNSURE (249),(316): Identity of amino acid sequences at the above locations are unknown.
NSQLSLLYSKEYLIIPFHYKYKFNRSFFLVLLVFAIMSSSSHNDNKIPPEKTTTPPLLLLNEDIYNPADSSNVLSSNQTLVSTNNNNDNNQNNNQNNNQNNDGKDTMDHLSYLSTIDSKRREQSYLKSFYQRFIIEDVVKNFTPAYFVSVMGTGISSSLLYNFPFPAYWLQICGYVMFGLTCTFFIGNIILLIMSCAYYPNRFRDYHVDPSRAVFMGAFSMGYITIVNFIALITKGEHIYFVWTLWWLXVFSAMYTSFLIVYLSFMSKLNESDVEAKLNATLLLPIVAITVVSSSGHSIELDLPHVHQTVLTMIVXFMLWSLSISMAFMVMTLYMGRLIIHKIPPTNLIMTSFLPVGFLGQSSYSIYLFGNNLNKFIPEELLYGKISLCLSGFVSVFLLSFGYFMCFVAVTSVLSKIRPFAKNPNPLHTNRFGLLKLEKSFWSMTFPMGTMSLSNTEIGHGGVGNYPLLTFKVMGSIFAAACIFITVGCSIGVVVYSFKKLREDMTNKNKYRNESMV

SEQ ID NO: 20438 - protein, 315 aa, Candida albicans
ILRIHNIPSKSTEPQLTVTRTETKKSLHDLGLTSSIPHPELNGPIIENPIFPEEYTLETTTGLVPVVTLQSIGRVKTIQEEEKLAGLDSEIEFVTFKVGDPENPHNWPMWLKWWYTFIISMFVISAAYGSSCLSGGLSTVNNKYHVLTEVSTLTVSLMVIGFCVGPLLWAPMSEEYGRRPTYFISFGLYVIFNIPCALSPNIGGLLVCRFLCGVFASSALSIAGASLVDMHNDTRGLALSFFSFCPYSGPVISLIVNGFIATDTERMDLIIWVNMAFAGVMWIMVSLMPETYAPVILKRRAKKIKKGNRKRQDND

SEQ ID NO: 20439 - protein, 595 aa, Candida albicans
RDFPVVVICSHHPNMSHATDSTLDNASVDSEKVRDFGDDLQNHPVQPTRSILSKIRSRDDDARSLVSNNKGVERIISDLQEGAGQLRPLEQPYDIKKIETHPDPHTDYNEADPWKYPIDLESGLRLVEWVDGDKHNPKNISKAKKWLYTLVLGAVCFVVALGSAIVTGDMERPAEYFGVSEEVIILASVTVFVIGFGVGPLVFAPMSEEVGRKPIYVVTLFIAVVFIVPCGAAKNIATLIVCRLIDGIAFSAPMTLIGGSLADIWEGPERGTAMAIFSAAPFLGPVCGPIFGGLLCDHAPTWRWIYWTFLIVAGVFYAIFIAIVPETHHGILLKKRAKKLRKETGDSRYRSFNELQIRSFGEVAKTSLLRPFVLLSELIVFLMTIYMAICYGLLYMFFFAYPVVYQQGKGWSASLTGVMFIPIGVGVIIATIAAPFFNKDYNRRAQVYRDRGELPPPELRLIPMMIACWFVPVGLFAFAWSSYTWVSWAGPCFSGLAAGFGFCCLYNPANNYIVDSYQHYAASALAAKTFVRSIWGACVPLFTIQMYHRLGDQWATSLMAFISLACCAIPYLFFFFGARVRTFCRYAYTPETNTK

SEQ ID NO: 20440 - protein, 391 aa, Candida albicans
LSSMSDNTTLDNISVNSEKVVDYTIHHDDRKELERLVSHNKGVEKIVSELAEGAGQLGPLEQPYDIHKVETHPDPHTDYNDADPWKYPIDKETKLRLVDWTEGDKHNPKNFGKGFKWLCTVLLGMICFVVALGSAIVTGDLERPAADFGVSEEVIILASVTMFVIGFGVGPLVFAPMYEEVGRKPIYVVTLFVAVVFIVPCGAAQNIATLLICRLIDGTAFSAPMTLIGGSLADIWEGPERGTAMAVFSAAPFLGPVCGPIFGGLLCDYAPTWRWVYWTFLIVAGFFYVVFIVVVPETHHGILLKKRAKKLRKDTGDSRYRSFNELQIITFAQVAKTSLLRPFVLLSELIVFLVTMYMSVLYGLLYMFFFAYPIVYQKGKGWSTSKTGVMS

SEQ ID NO: 20441 - protein, 193 aa, Candida albicans
ELGKLYYNGFEDIVLIDKKYGLELFAQAAALGHLQSAAILGHHYEIGEIVPQDSNLSIHYYTQAALGGDPNSMLAMCAWYLVGSEPYLPKDDNEAFEWAKRAANCNLPKAQFALANFYEKGIGCIKNINEAQSWYKKAAENGDEKSLKRLTDKELVKTIQKQWKKKPPVIHNEDGTSTTNSGSLAQEKDCVIM

SEQ ID NO: 20442 - protein, 184 aa, Candida albicans
TNSLSMTSNNRRSVYIVSRFLVCFSFTYNQKWLQTKQNKTKQTNKKRELSTVNPTSPSTTLDSNHMIYTAEQIRHKKKLKKGINFNLLVVGVNDLGKKTFINTLINQPYYQINQPIPNTSHSSIAGTSNSEFSENSFNNNEFSIETNSFGMCLFIFFLSFCLSNKKNEFINSSSFLSNLVWSGW

SEQ ID NO: 20443 - protein, 373 aa, Candida albicans
LIQTNSNTSVLISQNIMSIEEPSTQHIAQPQKYVGFDTITTQIENRLLKRGFQFNIMVVGRSGLGKSTLVNTLFSSKLTTSQGRKLPSEPIEKTTEIKVASHSLLENNVRLNINVIDTPGFGDQINNEKCWEPLVKYVKEQHSQYLRKELTAQRDKFLADTRVHCILYFIPPNGQKLKQLDVQALKKLSEIANVVPIIAKSDSLTLDERSEFKKLLQLEFMKYNFNIYPYDSEDLYEEERQLNEDIKSLIPFAIAGSETEIEINGEMVRGRKTKWGAINIEDVSQCEFVFLRDFLTRTHLQDLIETTALTHYETFRSKQLIALKENASNPNRQSQLQKDQGQTSQQSNQDLKNASGVPNAPMFQSTTGTAAAR

SEQ ID NO: 20444 - protein, 228 aa, Candida albicans
CTITEQQICKLNTIRFVCFCYNYFGFKFVFITSSWHQNHQCCSFIGYLLRWCRSNNSWYLGFLFWRYLEYVYIKIGNQFIKQISLLTKLLLVFTALTSYGAFWLSFAAINIPTFGILAAYQKDMTQLSSALAFYLIAWAILSFIFMLLTFKSTVLLSGFFLCLTALFSLLSASYFVGSVALTKAAGAFGVIAVVAALYDTFALLATKQNSYFTLPVIPLPGSEAKQEK

SEQ ID NO: 20445 - protein, 135 aa, Candida albicans
VMVSASTAESKDVDSVGSPNGNNVTKVEISGDGGEFVILGNKKYYRHEIMSVLAHNAQSLSSKFASSTPLGLCAFAITTLVLSLYLLQARGIKTINVAVSLATFYGGVVQTIAGIWVFFSGDTLSMYISKLEINL

SEQ ID NO: 20446 - protein, 109 aa, Candida albicans
ATQYTIPKFLMSSGDSDSNSITSLKDIDGADTNSLNQPVSIVRTTGDGDEFVIIGNKKYYRHELMQAFGGTFDVGLHPPPKLKIGNPSPLGLCAFSITTYNHEFIWIKC

SEQ ID NO: 20447 - protein, 63 aa, Candida albicans
LLIIMSLYGLNVKDIHNNNVVVGMAIFYAGTMQTLAGVWEFFVGNCCIIVAFDSNKEQIALPI

SEQ ID NO: 20448 - protein, 176 aa, Candida albicans
FPIIKIYNYIKYLTFLIPFIPNSCFTSFRHMFPFLDIQFKCKRTHVVQSSSNTNHWEDLLLLYDSNTFATTTMISYGTFFLSYGALYIPSFGIMKAYATVDPTLKELQNAIGFFLIAWAIFSFFMLLCTMKSVISLFVLFVFIFFTFFLQGIGFLLEHHGLIKAGNVFGILVTAAG

SEQ ID NO: 20449 - protein, 308 aa, Candida albicans
YTAIKGQPSIHIDTSFNYHYKSNKINQMSSLESISSELKAVPIADEIENVVLPYKTCTITGEGNEFVVIGDHKYYRHELMQAFGGTFNPGLAPYPKHSFGNPAAIGLVSTGMNILIFGLFFAHAMGIHIPNDGIGLCMFMGGLVEILAGIWGFFVGSQVGTFVLTVFTSYGAFWLSFGAIFIPSFGIIQAYEEDPEQLNHAIGLMLIGWAIFTTMLLMCVVKSTLSFFWALLTYDLTIILFAAGFLSDNDKVKVAGGIMGVINAFADWFEAFAGVANRQNSYMVPREIPLPDLSVWLKRKKAVSKTSN

SEQ ID NO: 20450 - protein, 245 aa, Candida albicans
KTLFPYYPNFIKSQVNKTYKTMSSSASITSDIKALEASSEIENVEPYKTCTITGDGNEFVVIGDHKYYRHELMQAFGGTFNPGLAPYPKHSYGNPAAIGLVATSMNIFILGLFFAHAMGIHVPNVAVGLFVFMGGVVQFLAGIWGFFIGSQVGTFIFIVFTSYGAFWLSFGAIFIPAFGIGEAYAEHPEQLNQGIGLMSVGWAIFTTMLVLCVMKSTLSFFWALFTLDLTIILLSSPRGWKEPRL

SEQ ID NO: 20451 - protein, 316 aa, Candida albicans
ITNYYNYNYNHYTYQIMSADLENQQPQDHHLIIENKGDNSSNHHHHNNNSTSPYDPHHPITKIETDGDYVTFGNERYLRSDLVEAFGGTLNPGLAPPPKNDFANPAPLGLSAFALTTFVLSLINCEARGVTIPNIVVGLAFFYGGAAQLVAGMFELAVGNTFGGVALSSYGGFWGAWAAIQVDSFGIKAAYANNTEELHYAVGIFLIGWFIFTFFLMLLTVKSTVAFFLIFFFLSITFLLLAISDFTGKVAIKKAGGVFGLITAFVAWYNAYAGIANPQNSYITVKAIPLPDLQDPTRKHKVFTTSCRMRDIYYGG

SEQ ID NO: 20452 - protein, 320 aa, Candida albicans
VYDRFHRRLPYILLNYKYLPVFLCISKLAKLLIIGFSYNFVRSTKNLIIDLLLKNMPSTSSQKSVGSSVMDPNEPPVGKVEVSGDGGEFVVINRHKYYRHELMAAFGGTLNPGAVPWPKININPAPLGLCAFALSTFVLSLFNAQAMGIKIPNIAVSLALFYGGLAQFLAGCWEFVTGNTFGMTALTSYGAFWLSFGAIFIDSFGIVAAYEKSEETVPQLKNALGFYLLAWAIFTFILWLNTLKSTVAFCALFFCLFVTFILLAAGEFSQKTALARAGGVLGVITAIIAWYVALAGTATTTNSYFRPISIPMPGNVAFKN

SEQ ID NO: 20453 - protein, 92 aa, Candida albicans
QFLLLVQFGLVRLVINYIECCPRSIPIKLKISVTNNFGFNVHNDSHGDTLLSFIENKHRAILHEELKICRNPNLQDNRLHLGLYFINANVKR

SEQ ID NO: 20454 - protein, 186 aa, Candida albicans
LYNKSLMSRFDYRNTSKNTSVVDPDHSSPIINYRKDAKKGIKFTFMVVGELGTGKTTFINSLLNKKVLNHRYEKLSPTVGDTKTLMFTLAKSVALPNTSILTKNEFNPRTINEEPGIALTETHIEIIDDDNQKLLLNIIDTPGFGENLNNELCFIEIENYLKQQFDLLLAEETRITRNPRFVDTRV

SEQ ID NO: 20455 - protein, 536 aa, Candida albicans
KRGSFQPRGEDLSMGMMPFASSMAGLAPPPPPVFDGSPSVEPMMMNYSNPMLSQTTEYSGASTPSKRRQSVSTFDTRPRSMMVDTPTPKANKRSSVPVYTSQQKQQQLQLQLQLQQKIAPVAKTTTSTPVKVQDSTISKKIDEFVRLRSRIAAGNKTPEYRLHWVKMLIVATNYKLYSYINIKGEPIYQEQAVSNKAQFIKSSVTHILKLIKELSSGTYEADGVKCEAYFIYANLLKQDYLVSYNQDFNMEKNIDKAIDYYDRVLEINSKDFKALYKLGEIYEYEFDNEFNKAVEYYTAAAKFGYNRAILKMAMLYLQEPQMRSIKYMKYLKDLSNIDLNEVRLDEEDSSEMEEVIGLACYELGKIFEGIYPGDLTQDNEFIQKSLDMAPVNYAKSLTYYNKSAKLNCLLAQVRLGIVYERGELNRQRNPNKSIQWYIKASSSPLSFKRHPDAMVGLARWCLTGSEGASKHIPVPVPDRAVMWCKRAIDEFSSPDAMSFMGELCEMGLAKGRPQYWYEKAYKMGNREAGRKLGYSN

SEQ ID NO: 20456 - protein, 279 aa, Candida albicans
RLLHRSMSSSSSIFSSITGGKRSVRSAPSIYSSSTATIPEDLEPVSTTVEQLVNDIVLHENHYRAVALENNHRNANVDVEEMYKISLGSDLQYQNVPESLIDWNLNVTRCKLILTQLPQITSTDIPYNQNALPQLVGDLAGVCHIILIQPHISDKELIYTLLSSNLYKEHDLDVNFKKSVAEISVKQSRLLQINNGAGSSSINPEHLFLKFKFKEIAIRNYLINLAAAATTAHEYKLKMEHLKGVLKMEQPDKKVKLSKEDKKVLWEQVRLDVFQRAGL

SEQ ID NO: 20457 - protein, 706 aa, Candida albicans
  UNSURE (586): Identity of amino acid sequences at the above locations are unknown.
VRGKQIVDIHRTVLFEPLLKILIAEGKFIKNLVGIGQTYSDWAFEVKPHLIKYMSCMPMIEELLGIETIKAFIDNRISTLPRVRDLKVNVGILFISTFNSRYMQLPLQLEDIYKKFDVNDPEHISMLKAANDIRKLGVRINDSKKLADNNYAISVIKDQLLWKSGVTQINLNLNSPNRKFVCRGDLTRKSVLSKLQTANINHIILLDNYVLITDRARNRRGGLAYKILEDPIPVEYLIVEEKVVSTSTLLSNQNSLGTTQLGTADAENDDSDAFQLKLRYAGRTKRAYTFSCGTEREIRDWVNYFIAAKSTLCKRLAHSNPYRVVLVSNTVFGYENSHRVTKLQLLARYDPIYDICQDSVEKTKKLNLWSDLYNPRLSRNRIVFSKLQCMCWFEYKGSKYNLVALEAGLYMCESKGRWKKIIGGDNYVQMQVDSEIGIVVVLTEKQLGYYPIHQILNVYNETKLNLTCIPLSKDTVLFFEMGRHKNVKMLFYAKKKTNGSIHFKVMIPQIDNGGIFSRFKDHARFYIEAECFGISIFNSSFAVHTDKGFEILTLDKLIPSSVPELPPPVETEKKKADPYATRKSKXTSLVETIRMLINAKYKPMGMYKLNNNKEFLLVYKEYAIFINKHGKPSRDFIIHFKAHHVYFENNYLFVVNDQLIEVWHIGDHPKKAQVIIGKDIKHLGQNGFSMANPLVPGLQLVFRLVE

SEQ ID NO: 20458 - protein, 111 aa, Candida albicans
IIGVIVWYIMENFTIVHPFLLADNRHYAFYIYKRLLSQSYLKPLILMAYHFSSFQIISSLIKGGQLSFIGIFSYLIAVGLTLIPSPLFEPRYYITPLIIFNLYINHPHNLL

SEQ ID NO: 20459 - protein, 261 aa, Candida albicans
INNTPFLSLTSLSMPLIIPSNDIYISIISKYVAIVIFLIFVIIMFNNITHHLTQPYIDEIFHLRQCQTYCQYNFHHWDNKITTPPGLYILGFIYSEGIKILTRSSSTGGGGGGGHLTCFNDNVLRSINLIGGVVILPRILQQFHNGWSKNSKNQFFWSINIISQPLLFTYYFLFYTDVSSTILIILSLSLINYKLLQYPMLSALLGFMSLWFRQTNIIWIAFIASNFIDRPIKIKTGVIDRIRQFNNEIIDKLEITNRVYC

SEQ ID NO: 20460 - protein, 314 aa, Candida albicans
ARCDFPARWGKTGNNVDNQDSWVPIIDFIDDQHESYMKQEQQPSRTAKKDLRVHACLYFIRPTGHSLKPLDIEIMKRLSTRVNLIPVIAKADTLSPQELDIFKTRIREIIEAQDISIYTPPLELDDPASAEHAKQLIESMPFAIIGSEEEVEVGPGQFVRGRKYPWGVVEVENDQHCDFKKLRSLLLRTNMLDLVLSTNELHFETFRSVKLGGDEQENGEENGTEELTNEKGEVIKKPSGSKKPRRLHNPKFKEEEDALKKFFTEQVKAEEHRFRQWETNIINERNRLNQDLEEMQSKLKSLEEQVKRLQIAKR

SEQ ID NO: 20461 - protein, 285 aa, Candida albicans
TNQVDVNKVRKFEKSISEALKENCTHGMIVRAMYCYGKLSHTSKPEAVTSTSVIKFGIVSLFKLGLGKAFSKAYSFAVKSFIKPFQLVVLLLKSLRMNVFLVFIIVLLSFLNLFLAGKTATSYWNTRSASKLAQEYVTKEPRMLQRSVYLKDLESILNENISIAESRPFSLFKQNSFIFNLDADSDWSNYFGSNARDVARLLKSSFQDIGIKRHELLVKLKILKSMEEEIIQAEWQNWLMSEAQKCDYVMDNVVGQIDEVDNYQEGVDNIIEYCHECKKILANLV

SEQ ID NO: 20462 - protein, 471 aa, Candida albicans
HISSTLQSTSLPMSNPQQQFISDELSQLQKEIISKNPQDVLQFCANYFNTKLQAQRSELWSQQAKAEAAGIDLFPSVDHVNVNSSGVSIVNDRQPSFKSPFGVNDPHLNHDEDPHAKDTKTDTAAAAVGGGIFKSNFDVKKSASNPPTKEVDPDDPSKPSSSSQPNQQSASASSKTPSSKIPVAFNANRRTSVSAEALNPAKLKLDSWKPPVNNLSITEEETLANNLKNNFLFKQLDANSKKTVIAALQQKSFAKDTVIIQQGDEGDFFYIIETGTVDFYVNDAKVSSSSEGSSFGELALMYNSPRAATAVAATDVVCWALDRLTFRRILLEGTFNKRLMYEDFLKDIEVLKSLSDHARSKLADALSTEMYHKGDKIVTEGEQGENFYLIESGNCQVYNEKLGNIKQLTKGDYFGELALIKDLPRQATVEALDNVIVATLGKSGFQRLLGPVVEVLKEQDPTKSQDPTAGH

SEQ ID NO: 20463 - protein, 421 aa, Candida albicans
KINKPLPFLSLIPNTKPIMNYSTENVSSAALRKRKTLKKSINFSIMIIGESGSGRSTLINTLCGGNSIVPTSLTATQDPFTKKLTLRHENVELEDNEGHKISLNIIDTPNFANLINCDDDFKIIVDFIRHQFDEVLLEESRVKRNPRFKDGRIHVLIYMINPTGHGLSDIDVKFLQHVNNLVNIIPIISKADSLTPKELKLNKELILEDLNNYGINFYKFNEYDYEQDYIDEEIIEYNKYLNSLIPFAIIGANEYRSNPNGSEDEDDILKLRILNKDFKPIDIDNAEINDFTILKNVLLVTHLNEFKDITHDSIYENYRTEALLGKQFQYVNKDSAKQEISESDYLMKEEQIKLEEERLRKFEERVHQDLINKRKELLERENELKEIEKRLLAEGLKFDENGDVVKVHEEVFTTGLEGTAL

SEQ ID NO: 20464 - protein, 479 aa, Candida albicans
LQREQELREIDIQCMKRLSKYVNIIPVIGKADSFTLNELQHFKQQIRIDIQKFNVPTFQFDNSLNDYDEDEDYDLIQECKFLTNLQPFAVVTSEDVFEVRESTTNTKGNNDKPKIIRARKYPWGLVDINDTRYSDFPILKSVLLGSHLQDLKDLTHDFLYETYRTERLTKVTGNGQAFDDEENEDAEFHDTVEHQLNDSNRGVGGDDNNNNTSTIPSMSNLAQLTTSTNEHDASHIDNNSITSTSSSIKKSTSMLIDDHPSSSPKLKNISSFTSSTSTVSLEGGEKEGGHHDRGANSTSTNNNNNNNNNAFKRLSIGPQRNQLRQISETVPYVLRHERILERQQKLEEMEQASARELANRAALLEKKAAQLKAKEKALRQLELNRQKQEELATSSLHRKDSDISGSVQSGGVDDGKSELTNNNNNNRNGYGYGHGHGHGQSHEYDNSEYHHDDSTPNYETSRLQKDETLTDLHWIVSNH

SEQ ID NO: 20465 - protein, 259 aa, Candida albicans
TKLIITGSKTIDDEFLMKLGQFKCGDNLQILDLRACELITDFGIYQLSLYCRNLTFINFGRKPISSGNGNGGGNGGGSGRYITDNSMIKLINNNRKLLTIGLAGCHITDKCVWEIANKLPNISRLSLNNCPKLTNSGINQIFTLTNTPNSNYFKCLSVLELRFNHQLTDLTSIIKFKRRQKFQFNIILLLELCESLMLKYRQQEFELDKLISLKIFQDISHWVNDYNDNDGDLLYNEIKHLINNNNNNNSSNNISARSF

SEQ ID NO: 20466 - protein, 426 aa, Candida albicans
IYSRRTILEKLRIIDITGCNAITDRLVEKLVSCAPRLRNVVLSKCMQITDASLRALSQLGRSLHYIHLGHCGLITDYGVAALVRYCHRIQYIDLACCSQLTDWTLVELANLPKLRRIGLVKCSMITDSGILELVRRRGEQDCLERVHLSYCTNLTIGPIYLLLKNCPKLTHLSLTGISSFLRREITQYCREPPSDFNEHQKSLFCVFSGHGVNQLRNYLNQVVEERTYQIDQGDIHTLFNERRRRFLNGDIDMDEEEMNIWERRRGLGVTADLGHPDMAEINREIFRELNEGNMGPDEMREHFQRLITNHHQQRLLEHQNRLNLQLVQLRQQQQLQEPQLEQENLQNRGQVETQAPDLLPNEGQLRLQPPLPQQRAQNTIINNPQNAPQIEQPAVFPNGENQTLPLVVNEDEDVDMEPVDLFPRNT

SEQ ID NO: 20467 - protein, 268 aa, Candida albicans
FISSMSSPTSLDDLSNMPETGNTIKTLHELKQESSPDSNNEMNIDGEMSNDNSNHSHSNHQMHTYAGDFVMDDEYNDYEELRKSVVNKRRLSSIKRPHGPFLDHNNQIDKRCLLRLPTEILLQIFHYLERRDWYSLLTTCSEIADLIIEMLWFRPHMQNDSAFKKIKEVMEINKSVTHWDYRQFIKRLNLSFMTKLVDDELLSLFIGCPRLERLTLVNCAKLTRYPITQVLNGCERLQSIDLTGVTDIHDDIINALANNVHLAVAGQR

SEQ ID NO: 20468 - protein, 486 aa, Candida albicans
ELYFIMEGEVEFWNKEGVIEIPIGEVIKSGSYFGRKVIFKLFTKTSPRIRTATIDSVTYCELMVIKSEYLEKLCDDYPTIIEDMKITAEERKVVKPAQGIFRPNWSINPTRTIPPQKRQRENENENVDYVPFTKRMRMASMKRRRSSALAIVEPLPETILMKIFGYLSLPDLMKLRRVSKRWRKMVTTTAPLEVLDLSQYSTTIDNKALIAITDFAGSRPRVIDISGCFHITDEGFSHMVNEIGIGGRLEVLRMASVWEVTGMAIMDLCFPGEKLEEIDLTNCRKVDDNVVQRLLQKCHLKVLNLSYCKGISDSVVPYFNNLESLDLTRCSGITDAGFAQLPFLPSLRKLSLKQCSYLTDNAIYSIANAARNLEILNLNFCCGLTDGSLLAIAMGFPYLREIDLSFCGLAVSDSSVASLSVLYYLERVLVRGCVRLTRAGLDTLFGGPCPLNFIDISQCRNAHVYPGNFPAPPFQSNLVRVSNKII

SEQ ID NO: 20469 - protein, 147 aa, Candida albicans
KTRTSTKMLLHLNPLATKHSKKPFDRQSRTGKTDFKKKLQQGWGQSDKRELEGEVEGTEDAEAELEAEAEENDESANAIPKKSLQEYLAELELSKQELEGSKKLRQANEGAEQKWTAEEKIEKQQEVFFASTHTKKAKSKAQKEKSF

SEQ ID NO: 20470 - protein, 476 aa, Candida albicans
VTQTSCVLEWDKLNLGTATLKNLILFKDGKKLGSIPQPLNNRTSKLSGLPIDKSFKVQLRLDTTAGTFLSNEIEVTTHKMTDLSGITVCLGDLTPNDQFNKEDIEEALKNMGAKYPVQQQVKVDTTHFLCTRENKQNPEYVKANDMNIPIIRPEWLKACERERRIVGVRDFYVKDCVLPDIFAKNYWQKTTSQTAGNFSAQSLPKESPAVPDKEGLPKTDLNKELVKDEPTEVDHAKEDSVTQEPAIEEISAVVSENIITPDIANEETDIVEGESTKIELVPTDEIDTKVESTPVAVETEDVVAESPADQDAAVTLEPTSVDDQELHQSDETLKQVNDGQQEIDVGDATEQPEKEEIDDIREQVNSTVNNTERQETATDDAFDTVPLEGDENIATAAKETEPTFTEPTESVNVTNVNNSASEEAGKDDNDDEDDEDEDADNEGKSNKTSEQSSEGSATGSPSKKKNKKKKKNNKKK

SEQ ID NO: 20471 - protein, 555 aa, Candida albicans
LYYIFFLHGRKLEELIIMSSNSSWSNNDSYQLRNNPNNGNNHNPHLMSQQHSQSVNIPSHLLPQAFIEQQQQPPQPQPQQYPQDGQAHNKNPPINNRFHQSQPPQLRHQYIPSKQEQMQQPYPTAEQNNQHFPPPQERSYSFSSTMDPGSPSKMTPPNFSQRNQSFSGYQQPPPQQQQYPQSPHKAYNQQTHTHQGGLQQPYIAQRQNMPPGYINQNPYSQQNRSVSSLTQDRTGAPVQHLPYPVNNDDPGYQLQPLAIQSHHPPQQQQQQQPPLQTRRQLRKAPSSNLPPIQTDQVYYSPDARRIVSTPTHQQNFPTPIPPEARTKSLTSASLKHQKQPLQPLQPYFQQISELPGKDSNARNSSSSSLHHTFSLTSKSRSFTSISKLSSLSTKKFGSSSSVNTNKLDRYQSSGTIRNNHNHNHTNQTSHNIHYAKPSVYPAILSEVAKLFKEAIILTINTKDGLEYHDTFTGKMAVDILCRIIRTNDRNLALLLGRSLDAQKFFHDVTYNHRLRDSVHEIYAFNNVYNDVDFFNEENGGAGLVSNGENSALNSK

SEQ ID NO: 20472 - protein, 681 aa, Candida albicans
LISTLCRYEILPIILFLITNVETFIQTVFGGVPDLLRLAKRLSEALTRRQQQQKPVIETIGDVFLDYVGDFEPFVTYSGNKVFATFEHERQQQVNMKYARFLDAIEKKPESRRQDLSSFLIKGVQRPARYQLLLSGILKHTKPESPDYKYLTKAKEEIEKLLVKINIQTGECTDRHKVMVLHRLLGKQTLENRFNFKLSYNNRIIYQVTLNRKRDNEKIDLYLFEHALLLVKHKIQNKREQHKVFEKPMYLPLLFVNSGMEIPTNRTIMPHRYHGSLVSDTSIRPQRAESNYIGNTLNSSSTPKFQLNFFGLGSNQVHASLFADDLTIQNQVLLQISAQQKKLIDANDIFSLCKFETRRFTGNNKINCAVPCYGGKKLLYGTDSRVWVSTVRSISATSNEKICSDPTMVISKTYVTQIEVIVEYSKLLVLSDKSLYEFDLSCTDSLDHVKNTKLGKLLLSHVSFFKVGVCDGKLLVIGARTGSLHSICIFEPVNPFDKSNKNKNKRLEIQEINFSSDPISISFLKTKLCIGCAKGFEILSSQTGTKESILDEADPSLDFATQRESVTPLAIHRLGRDFLLCYSEFVFLINRNGWRTNHDWGIFWEGNPQNVAIFFPYLLSFEPGFVEIRDLHTTNLLRALTGENIRFLHSNEHEAMFACEENGYDIIISIDFLNLKPKSPT

SEQ ID NO: 20473 - protein, 182 aa, Candida albicans
ALNDHISDYHTSQSSGSLTKIASSATDNGSVGVAGKELSASQQTGVNGVFTILTECYSPTCSRDSLCYSIACPRRLEQQARLNLKPQGGLQRAVSKLSLHDQEETETLWHKTVPQSVLDKLDKHEKTRQELIYEFVYTERDYVKDLEFMTDFYIMPLRNPANNIIPDYQCRNIYSNCVWGSA

SEQ ID NO: 20474 - protein, 139 aa, Candida albicans
AKTKSITGEFQINKQVGMIQAHRGGLFNTLRNLGVQLESGEGYYTPLTEENKLRTMRQIVEDAKKPDFKLKLSYEYFAELGYVFATNAENKEGSELAQLIKQYRRYGLLVSDQRIKTVVRARKGETDEEKPKVEEVVEE

SEQ ID NO: 20475 - protein, 231 aa, Candida albicans
IQLHQGNVRYRKDTETDSEVGYLDIYLRFNDDMEKDYCFQVKTTTVFKDLYKVFRTLPISLRPSVFYHAQPIGFKKSVSPGYLTQDGNFIFDEDSQKQAVPVNDNDLINETVWPGQLILPVWQFNDFGFYSFLAFLACWLYTDLPDFISPTPGICLTNQMTKLMAWVLVQFGKDRFAETLLADLYDTVGVGAQCVFFGFHIIKCLFIFGFLYTGGFQPNESVPFNTQEVSN

SEQ ID NO: 20476 - protein, 369 aa, Candida albicans
TVPVLELLMNHLDLQINTIEQWLTALASSFKKIPKYLKEVQSYSNSFLEHLVHTFIQDGIIDQEYTVTGLNTTLDGLKTVWGLSIQALSVDAKNLKSIELFKRHHVIKYKETRKRYEDYQAKYDKYLSIYLSSSKSKDPLMVIEDAKQLYQVRKEYIHASLDLVIEIQNLSKNLNKLLVGVNTDLWRNKWNIFGSRGVGDAIKEEWDKIQRIQSWNDSYTLAIEKLNSDMLAARNQVEEGCHIQFQPSTNVNDYKSTIINNRTLRDIDEPGVEKHGYLFMKTWTEKSSKPIWVHRWAFIKNGVFGLLVVSPSQTFVQETDKIGILLCNVRYAPNEDRRFCFEIRTNDFTAVFQAESLVELKSWLKVIEE

SEQ ID NO: 20477 - protein, 242 aa, Candida albicans
IPDFRPLARSLFEGAVEPGEYCVLSYSCIWSPNSKQELSGRCFVTNYHMYFYMQALGFVALFKGFLGHLVSVEFVSQKNYDLMKVYNIDGVIKMKVFLDDAICIKKKLVYLINNIVSDKPKSLEGVLADFSDIEKEIAVEKSDQKNLREIIQLSKGLSSKSLASEKLLLSGETSSILPGKSGRMIKHTVNFTPYYNLISDRTYPAPPKAIFHALLGDNSVVFKSQLSFANTKYFLQKTMGNL

SEQ ID NO: 20478 - protein, 148 aa, Candida albicans
GKKNNNNNNNNNNNNRMSSLKDCKLSKSKREELKALNNAGKTPRRVKVYLLNGDDWIDNGTGFCVGEIDDDTKLPYFLVRNETDNNNIILKSFLEGSIQYQRQQETLIVWTDSNGTDLALSFQETEGCADLCDFIIRVQQGNIIPGIS

SEQ ID NO: 20479 - protein, 403 aa, Candida albicans
ISDDMTLISILSKLLVEDKNIGLKMQAFEALKTLLDPNIAASSSGGSNGLSPTTMGGMGTPNGSGSGSNSNSLFNSSNANANANANTNTNTNSVNKSIGINTNNIEEFKFTSEEFQEINTSTYFRAFYEQVAPKLFEKLIILANHNLESKQLQINTKHEELLYQLLCELISFCTLEHKMISLSSLSSSSFSSSSLSSSLSSRSFFIENHIPLGIAKLLIIDDCKPILKLTSIRCLKNLILLNDEFYTRYFINHDLWFYFFKFFNNVIDENNLANSTCLDFIEIVIKGCDIGLNNNNNNNNNNNNNNSKRSNYILLAKHIYKKYGEFIEKKLNYVDTGKRLIDLVTHSLNSNSNSNVNKLNGGQTFNENNKEEYDEEDNEYDNENEDSDENIATNTDDLGLSER

SEQ ID NO: 20480 - protein, 176 aa, Candida albicans
  UNSURE (3): Identity of amino acid sequences at the above locations are unknown.
FPXVKIAQFTRTNILEFIIENDYFTKLINVSNEAENNENANVLYNISDIVKSLFLYNESLIIEYILSSEEKILGLVGILEYDSEYPNYKASHRNFLASQSYIKVIPVENIEIFKRDFYLNHLKDVVSARFLDDSTCNLIASLIYSNHLEICNYIKDSEILEHLFSIYDNCNDEKNE

SEQ ID NO: 20481 - protein, 187 aa, Candida albicans
MSESVRRKLVIVGDGACGKTSLLYVFTLGEFPTEYHPTVFENYVTDCRIDGKPVQLALWDTAGQEEYERLRPLSYNNSHVILIAFSLDTPDSLDNARSKWVVEVKKYCPNTPYLLCGLKKDLRTDESDRVNFVQFDMGQAMADVIGAKKYLESSALTGEGVDDIFEYAVRTSLLKNDKANTGCCTIL

SEQ ID NO: 20482 - protein, 68 aa, Candida albicans
LFATLDVGFFTLASANMTGNATCTQVGGIFVVISSICGWYGMISGMADKFNSYFTVHPLPVPQFGKKN

SEQ ID NO: 20483 - protein, 291 aa, Candida albicans
LSYVLYSDHPSSYNMSSSSDPSIDKDQCSIETDGNNHHHHHHHHPIRTVSYAGDGNEYIILDNKKYYRHELMTAFLGTMNPGYTPISTHKFGNASAVGLAAFGLSASVLGLYYAGAKNISIPNVSISLAIFYGGLVMFVSGIWEFFIGNTFAYTVFCSYASFWLAFGTMNVPAFGMLSAYENSVELGNAIGFFLIGWGVFSIMITLLVFKATVLFVVLFITLDVGLFTLAAANMTGNTTCTKVGGIFVVISAICAWYGMFAGIADRYNSYFTINPVPIPHLGGNKKQKEMR

SEQ ID NO: 20484 - protein, 256 aa, Candida albicans
KETTMTSSSSQKSVGSSIIDANQGPIKKVEIAGEGGEFVIINRHKYYRHDLMAAFGGTLNQVLLLGPKININRAPLGLCGFAMTTFVLSLYNAQAMGIKVPNVVVSLACFYGGAAQFFAGCFEFVTGNTFGMTALTSYGAFWLSYSAILVDSFGIVAAYEASEETASQLPNAIGFFLLAWGIFTFMLWLNTLKSTVTFSSLFFLLFVTFLLLAGGEFSGRVGVTRAGGVFGVITAIVAWWNALAGTGTSSPRMEVR

SEQ ID NO: 20485 - protein, 280 aa, Candida albicans
FFSFYSGSIKLNSAIFHHFNSTRATPYFGIRTTTMLSRTIIYSVRQLSCTSALLNKSTKPKSKAPKKKLQKEVIYGPLSDAQKAYLDRVIRVDQAGELGANYIYMGQYAVLASKYPHLKPVLHHMWEQEIHHHNTFNKLQTKRRVRPSLLTPLWKLGAIGMGVGTALIGKEAAMACTVAVETVIGGHYNQQLRVLLNQYGVPIYDKKTGALLSPDTVEKTAQTSEELTELKNQISEFRDDELEHLNTALDHDAEKAVPYMLITEGIKLICRGAIWTAERI

SEQ ID NO: 20486 - protein, 577 aa, Candida albicans
SSGVTIITDNTITFTSPSIYHQQTTTSSYKPNLNCLLNGYMLNHEIRFIRKIGAGTYGLIYLVENIYTKQQFAAKMVLEQPLLKQKQQQQQSHHGHKGESSMNKQIILQEFYQYFLNNSMPQPRNLDLNYLRDNGHDCPFLTEISLHLKVHQHPNIATIHQVLNIEDFAIIILMDHFEQGDLFTNIIDRQIFTNNSHRKVPRTDFETQLLMKNAMLQLIEAIEYCHENNIYHCDLKPENIMVRYNPYYVRPTINNNNNNGEDDLCYANSIIDYNELHLVLIDFGLAMDSATICCNSCRGSSFYMAPERTTNYNTHRLINQLIDMNQYESIEINGTTVTKSNCKYLPTLAGDIWSLGVLFINITCSRNPWPIASFDNNQNNEVFKNYMLNNNKAVLSKILPISSQFNRLLDRIFKLNPNDRIDLPTLYKEVIRCDFFKDDHYYYAQHQHHHNHNQINNAYNHYQKQPNQARPIANQQLYTPPETTTYNSYASDMEEDEISDDEFYSDEEDEDIEEYEEEEEEYFGNEQQQQQQVTTVNGNFGQVKGTCYYDTKTKTTTYIKPPAAYTLETPSQSVEYC

SEQ ID NO: 20487 - protein, 285 aa, Candida albicans
PSFLILIKREIKSLSIFLSLNYTIMNHSNTTNTDRDAYLQLGKSLNEQHSNQLSTQLQVFQSALINFANDHGDEISLNLEFKNKFTQIVQLIGIDPLDLLLYTSQNDRNGGTSNSNSSSNSSSNYKGSNVVATNFGVALAVKIIEICQQTRDLNGGLISLKELISTLQNSCETEGISLVVLEKDIESSLNNLNTLGKGYEILIINGKKWLKFSSTENLSNDQLKIYELCEFMGGYVTYRLLRDNYGWDKVRCKTVIDEMIMNGFLWVDSQDNGEWQYWEPSWISN

SEQ ID NO: 20488 - protein, 201 aa, Candida albicans
LVQRKIVILGDGACGKTSLLNVFTRGYFPQVYEPTVFENYVHDIFIDGQSVQLSLWDTAGQEEFDRLRSLSYSDTHCIMLCFSVDSPDSLENVQSKWVGEIADHCEGVKLVLVALKCDLRNNEDIEDQQQSNPYSSQKRLITYEEGLAVAKKVGALRYLECSAKKNKGVNEAFSEAARCALNAKPKGANDNEPQKKGCVVM

SEQ ID NO: 20489 - protein, 201 aa, Candida albicans
TYIMVNGPAELRRKLVIVGDGACGKTCLLIVFSKGTFPEVYVPTVFENYVADVEVDGRKVELALWDTAGQEDYDRLRPLSYPDSNVILICFSVDSPDSLDNVLEKWISEVLHFCQGVPIILVGCKSDLRDDPHTIEALRQQQQQPVSTSEGQQVAQRIGAADYLECSAKTGRGVREVFEAATRASLRVKEKKEKKKKCVVL

SEQ ID NO: 20490 - protein, 412 aa, Candida albicans
MSSSSSSLGVPHENPIRHRSSSVGRIDVGDTSASLSTMPTTRSLRRRSIARLKELQDNSTTDSAIVHKLYVGFRELTYRHTWIIPLIVLLMAFGTYYLSSPSGKVHQVLEDMIIPSYHIPGTDQYGKGGNDFKFVGFYAIFFTFLREFMMCCVLRPISVWFGIKKEAKQKRFLEQTYAMFYYGITGPFGLWIMRRLPLWYFNTTQFYINYPHKTHDIYFKIYYLGQAAFWVQQSVVLILQLEKPRKDFKELVLHHIITIALIWCSYRFHFTWMGLAVYITMDISDFFLALSKTLNYLESPITGPFFVIFIGVWIYLRHYINLQILWSVLTEFRTVGDFELNWIPQQYKCWISQPITFFLIFALQLVNFYWLVLIFRILYRYVFTGVSKDERSDDEDEDEDSEDSADEKKKEQ

SEQ ID NO: 20491 - protein, 420 aa, Candida albicans
LSMRFSQATVLAFAALSLAAPAFEADNKNIKREDCDKTSFHGHHKHKRAVAYDYAYVTVTVDGNGNPVTTVSPVLSIETIAKSEETSSTSTSISSTTTIVQNDSLTSDEPKTLSLPSGTIKPSSSATESQSQSQSSSTGGSGSGSTNGIEGDLAAFEDPTEEFQDGVLSCSDFPSGQGVIPLDHLGFGGWSGIENSDGSTGGNCKEGSYCSYACQSGMSKTQWPEDQPSNGVSIGGLLCKNGKLYKSSTRSNYLCEWGVKKANVVNKLSETVAICRTDYPGTENMVIPTVVGGGSTSVITVVDQSTYYTWRGGATSAQYYVNNAGVSWEDGCVWGTPGSGVGNWAPLNFGAGYANGIAYLSLIPNPNNRDSLNFKVKIVGESGSTVSGSCSYANGKFNGNSDDGCTVGVTSGEADFVLYN

SEQ ID NO: 20492 - protein, 177 aa, Candida albicans
LLLTVLSTALATPLQHQHHHHHEHARRAEVTKVVYVNGNGDEVQSQVTENASSGASSGETAETIQTRSSSDVSSSSDSNPVASIASSVASSASSILSNIEGDLSAFSSPSKKFEDGVYDCDSVPVGQGVIGVDWISGLNGGWTTIMNENGDTSLNCKDGYYCSYACQAGMSKTSMAI

SEQ ID NO: 20493 - protein, 433 aa, Candida albicans
LDFFPQMSSGSIATTTIPSTPMSIESIEDHQYHNSFLAMVERNQIPLSRNLLIILYLSHLLLQNNNTTITPYTSKFIHIQNCVGIDEFTGKSIYDIDINDTYFVIHSLVIVTFLRSFLMKWCFEPFASKFCHIHSKKAKTRFAEQSWSFVYYSISFIFGVVLYWDSPYYNNLDQVYINWPNHYMSWEFKTYYLVSMGFWLQQIFVLNVEKPIKDHYQMSSHHIITCLLIIGSYYYYYFRIGHLILMIMDSVDIFLAAAKMLKYAGFSNACDAMFLLFLVSWIVLRHGVYNYIFYHAWYKSVDLMKNGQCVEGLMQKRCWTPVVIDTFLGLLGGLQIITCIWMYLILKVAYKVVTGSGAEDVRSDEDDTDIELEEEEKEEEEEEEVGQPIFVEKKEEEVVLEIEEDKYSFERDSFSSSSESTLDEKKDIRKRKV

SEQ ID NO: 20494 - protein, 327 aa, Candida albicans
TEISKNPLHMMGFKKIFKVENQNSEYKFSRNDIKSSQLGKGITGSVDLYQSKTLPRFQYAVKTYHTKDIHESKKDYKTRVLYEYLILSELSHCNIIKIYDYDVSFFGSTIKLFLELGTANLNQLIIKQTNTFNINEMLCIWKQITNAVNYLHELDICHRDLKLENVVFDVNYKLIKVIDFATAQKLNNDELSHGLVGSESYTAPETYSSIQYDGKSSDVWSLGIILCYLINKKQPWKLAMWSNSDYQQFINQDNFLQEPYFVDFPVESLLLTSQILEQDPLRRIKINDFFSDKWFSLIQYCGCGVAGGGIDNKTCGIDHGKSFRVKT

SEQ ID NO: 20495 - protein, 901 aa, Candida albicans
LYIYIFFLISYIYINFLNSYSRDTGLVPTFRLNLTFWNKNMSGLEHLQNLSIQPSNRSTQQQQTNSQPQSQYSQLAAKRRSARDYQFGAKIGEGSYSTVYSALDKYTNRTYAIKVLSKRHIVKENKIKYVNIEKTTLNRLGQQHPGIVQLYYTFQDESSLFFVLDFAEYGELLSIIRKFGSLSESVLKFYMCQIIDAVRFIHLKGVIHRDLKPENILVGHDFNLKITDFGAAKLLGNHEEFNGEKIDYNSVDASPEVSDTDRKGSFVGTAEYVSPELLKHNICGFESDIWAIGCILYQFFNGVPPFKGSTEYLTFEKIINVDYSYKSPIPLPPDVIQLIDLILISEPSARATIPHIMSSRWFSDIPWDDQNFIWHRKVPRFEAFGAITPSPAMPPMMKNGTNRNVNKSYSYHQLQSQILASECGFIPSIAAKKSYKPPTMIKNNVAMPALNQTTYNHNYQQHVPLPPPVSSQPLTQQNVPQQIQPQRSGSAQTPQFAPVSASSRQPVGNMQTRQAAPQVLVQQKTPPFPKEKNSTPNLRDNTSFAQMAPRRNGEIPGQPQQQIPLPKSQQSPQPQPKAQYQLQQQKQLEDIRGSKNTSANAAAAAFATKNLPQPNHKTSKDSSTPPPPPPLPPKIKKVQENFIKFNEVSGLLKPDEKILKMDNLIKLVLSKRYLNKPEYQVLDDSVLDELTSKYASILKQESKAVITIVTNMARVFFIDAFLNVMLVDLKANKGADYLMYDYEFENTVDEDGNLLSKQDETFGYLIIELIKDGGDLVFLQRVSDEQRLRLTNAVKVLDKKGEEVVVGSSHGWIDCLLIAREISIEQSEDNKKPRSVSSSSNVSINEVKSEKAKKKKLSLSNKKPRSKKKGTSSNGTPQTTPTPTQHSNFAFAAAAAVHHQK

SEQ ID NO: 20496 - protein, 270 aa, Candida albicans
LIRMHKFRYSLHQHYSKRNSSDKSKDSPISQNSNEENDSTKLSSSSLQDLHDDLDDIYNNYTLAQGTNNNSVDTLDSENNQAINKFIDKPPAIHGMEPQLPVMHVSSRLSSLGNTTNETGESIAKSAPGTPLSSHSFDFRPHHPRAVTNSSLNVLLDTPNVSSEFNHLVDQTPPNESVERFDDSNNTVDNTEEEENNDDTDEIPKSETLKQNEENWEKKGAAVKTIKTMDGEMKTIRRNVTDFKFGKELGEGSYSTVVIRPSRWKIIVER

SEQ ID NO: 20497 - protein, 360 aa, Candida albicans
TKFISIMQHSRQPSISSSIMSQSNHNHPQKIGPWKLGKTLGRGATGRVLLATHQTTGQKAAVKVVSKSELQDEETEKNGDGLPYGIEREIIIMKLLTHPNVLRLYDVWETSKALYLVLEYVEGGELFDLLVERGPLPEVEVIKYFRQIILGTAYCHALGICHRDLKPENLLLDSQLNVKLADFGMAALESNGKLLETSCGSPHYAAPEIVSGLKYHGAASDVWSCGVILFALLTGRLPFDDEHIRNLLLKVQAGNFEMPVDEVSREARDLIARMLEVDPMRRISTEKILRHPLLTKYPMSNEDLISEKSLPHPQTGYKSLGSVRNIDKQILSNLTILWNDRPEEEIVDYLLKDGSNPDKT

SEQ ID NO: 20498 - protein, 524 aa, Candida albicans
ATVRPVPCVKTDEIVEEDQGRVNRRSTRNTYYERERDYELPEPTVEDSNLTDDYMTEIRKSRLLNSQLNVRDPLNEKRKSEPKTLISNVQIPSVTRKSRNFTTSNKRLSVLSMYSTKESYRDLNSIINSPDENPEQHQNMNKPALRTSIADRLDKAGLAEPEYETETDGEDKVSVIDLDDHLADRRTSYYDGSGKRASRASTTKRYNVHSSSGQRPKSKVPDLPKNDYDDTFVSNSDEVHKRQYKSMVSDESSASDDVFDKIKLPDGKSTKSSIDELANGTSTSGHRKPKIRHSQPGPEMLIPHLNGGIESSQPMSKVRGNNSSGHDDSVPPPPPAHKVNKKPLDDKTNFPPPEVDPKRKGSFFRKLSWGSKKTIENNTNAATNTTTQQQLPSPAESKEEKPKSSFFRWFSSSNTPSAAEIRKFNTILPKHEMSTALFALLNSWSNFGLKDLRNDQVGYYITGAISKHNSFNLKSCKFRIKINQRDFNQKSEIVCVRVKGSKVTTDTLFSEIEKVLLKEGVLDK

SEQ ID NO: 20499 - protein, 316 aa, Candida albicans
IGRTSPSKRYSYNQSPTKSPYGRRSNSQRQFENEPLKAKPRNIYNEIVDAQSNFSLPPSLPPSLPSKDSRYMIDEPNQPQLQQPALSQVPENPIVDESPDLMQSAKISSGKRNSIIGKNNNNSNSNKRMSKRKSIRASMTTGLKRNSITMKLLSTYAKLSGDDDWEYMDKQTKRTSATFAALCDKIFNQEDYDEEDEQLVDPEEKEAKEYERLMELERKKHEAELKARRELEKKKRRQKRRSILSSKKLSIIVKNDADPNNSEQELVDEGIKQPKRQSKNLTALRALSEGNHASEELTLEDVENLFFTTGDQPIRD

SEQ ID NO: 20500 - protein, 256 aa, Candida albicans
RLYKKQPKKKKKYIYKCRFSPNFGFSLVLINKHTMTKTGKFTPWDETTGNKTTTANNTSYILSKKPLGDGSYSVVFECKNTSTGRHYAAKKYTKRLMYGFENMLKNEFKVLNRISLSHSHLLSLIDFFETEESFYLVTDLARGGDLWNKIAEEEKLNEQTTRTITRQLVESVEFLHKHQILHHDIKAENVFFQSKHQDTILLGDFGLAKILQPQEKLHEVAGTLSHMAPDMSDYNMGYDFPIDVWAQGVCVNPMLC

SEQ ID NO: 20501 - protein, 228 aa, Candida albicans
  UNSURE (153),(190): Identity of amino acid sequences at the above locations are unknown.
TMSTQSGITISSQLNDAYKNLSTNSALIIKISSDSTELIPDQIITGSDNTTSTTKDITILEPIFEKLINQISQEFPHPSYIVISYNSNQYFISFIPDIAPIKQKMLYASTKNSLITSLGGNKLIKKFAWTELDELTLNYFIKSIDDDQGSNIXKEEEEELNLLLTEDEITLQKLNNLSLYSTTNHHHHGXKKKLPSMTNDDGSTTGNGNADQDILYKFTHKLLNNYNQ

SEQ ID NO: 20502 - protein, 190 aa, Candida albicans
IYPQITEQLQSIIENSSPESSNDNDHKKSLISFNTDTTKELLTLKSIDTQIEINHLIDTLNNHTSSRISPQYILYNYQIGKLAFIYSCPYGSSVKDRMIYASFKNSLINHLNQLIKSTNIDDDIIIDKNIEVGDLDEIELSQLQDANELIHDTNTNGNNNSSSNSLSSNNSSLSSKNGLKFNKPKGPRRR

SEQ ID NO: 20503 - protein, 302 aa, Candida albicans
SIINPVMTDHLIAKVQEHVPNIPLKIISQGAEALVFETSVHPYYNYNSSEKHHESPSLHNHTTFIIKYRPTKPYRHPKIDLQINKSRTIGEVKFMYKLSKLNIACPNIILTDFNNGIIWMECLGSKLPNGTISSFKNWLWYLESQEKEDPSINLHDDDQVELVCQKVGQLIGRLHLNDMIHGDLTSSNIILTEVDTKKNEDTDANNSSVYFEPALIDFGLSSFSGLAEDKAVDLYVLERAILSTHSNYADKLNGWLLEGYQQIHDSIEFNKTKQQLGKLKLKDTIKRLEDVRLRGRKRSMLG

SEQ ID NO: 20504 - protein, 420 aa, Candida albicans
FFNIIPLQSLMVDFAKSLFGFGNYKKESSLQSPTPPPSAHSSQEQHHKSNTEEYPQSHLSQQQHSHRYQPPHMSEQSHQFPQQQQQQQQSGTNKFFPKTLVSAAPTTAVANHSSVYGTTSTTTNNYPEAYLNQTFKNNIYNPQQQQQQQAQQPPPEQQQSSAPYQNSANIQQPYGNQWGSSQDQDANIITIDKTGNKLSPASRDSPIKGKLKVTILEAKDIFATQPYVVCSFESSEFVTNAPDSYGKSPVSSFGHNNNQGHNGPRNMYNSNHGPSPKALPMKNSGNLFGQRPSMYQRQLSTPHLNLPNDSSNPIWNHDTIFDVVGLKSELDISVYDGARDDAFLGHVRISPSTDKNNKNESEWLQLGARITGETVSSGSILKLNGNIPHLIITSKDHMEPHDFHFLRIIGKGTLGKFSSS

SEQ ID NO: 20505 - protein, 376 aa, Candida albicans
KKPNRVYAMKILSKKVIVKKKEIAHTIGERNILVRTSAASSPFIVGLKFSFQTPSDLFLVTDFMSGGELFFHLQKEGRFNEDRSKFYTAELILALEHLHDNDIVYRDLKPENILLDANGHIALCDFGLSKADLNMDGTTNTFCGTTEYLAPEVLLDEQGYTKMVDFWSLGVLIFEMTCGWSPFHAENTQQMYKNIAFGKVRFPKDVLSPEGRSFVKGLLNRNPKHILWASDDARELKAHPFFADIDWDLLRAKNIPPPFKPHIVSETDISNFDTEFTSENTSALKRQMEMATTPLSPGIQANFKGFTYVDDSTMDDHFARSYRANAFRPPGSFIPGDPNLPPDEEVLAEQIEEEDEMEVDEDQHMDDEFVNGRFDL

SEQ ID NO: 20506 - protein, 1379 aa, Candida albicans
NPPCVNTSFHFSSAYQRKHKVKLLHPYNHFNPSKEGIDNVNNRRSVSYETQRIKLPFQAMKLQSTDTLQPRISSDSLVYSSSSSSSNVYLQPKLPFARSYSSIPEQVHDPGSRQSLKNSNTNFSFSEHDDSIQEFLISPIQSDIFPYSKKPVISPVLESPEAGGDSTIVETSSPSPTKSGTVSLNSNAIGSIIGSYDYSKSSLELEKPKPVEEPVFQKDHARDHARQGSDASTISNGSEQVSKDKRFVRYAMNTQSPLVNASNKWQISNVIKWLDKNQFNNSWKETFRRNEISGNRFLELENFDKESMIWKQFSKFLQLDDDLNSVDRFIELLRKESSHELQTRKSLGGGEISPINVKHENRKSTPIYTKHMSTSSVSSSNSSSSISRPLSYVDSKPKEQLSSPSHHLFFRKHSRSTSNESKDAKKRYSSFDDNRVKSVPKNDKKSNGILSTLRKYGGDKIAKNTKQRSSTYFPSLDLPPPLESDPPAYNERKISVDSELSPKSIKSFSDDLSIDPKYLPTQHQELDLRKFHDCEPITILASKDNILFVPIVITELSNAKSHIIKALGLIDIGSITLHLTDFFHKEGEAIPDFLIPKVLKLDGLLKFYVRQELKSPEGTTTTFSTTSSDSKSYIADGNKTYPETPQYLLQAQHDSRVDYWNFKDLTSISEDPSKSLAGAKQNIDSKHNDTKQKPKEFPLKFPFANAPKKGNTVPQLQIDTSGVNNISKPPTLTGSTFQVLRKKGHEIDFDKRRKSPYESKTPKIIANIYSSSVANTKKSPISASTVMALKDDVVVQRPETISRSNSIIAKRAAPPPPGDRRVQIQRHNSILRRKPGLKSTNNVTSGSSEGSKKNISDSTDDNDSEDAFFVKPLKKKENELGNNSDNNSENDEDNDSDDDFFVKPIKKEVADVSAGKVELDDSEEDFFVKPIHKKPSHMNVRPPVEEVYNNLEKYFPYTNLDKPIIDDSPASPSPQRRPTISRTFSSANKSPVAPTSADSKNTNDEQPSLRVRRMKTIRGVANEARRKVLQMKQASPPNTFANITRENSAKLTRSNTKMWGQRVVEVTSQEIEKGFVSKLRNKNGLYQEYAWIKGELIGRSSFGDVYLGLNVTTGEMLAVKQVVCGRNNKEGIEALHKEVETMKDVNHMNIVQYVGYDQQKNIYSLFLEYVAGGSIALCLKSYGKLEETLIRVITKQVLLSLKYLHSNNIIHRDLKADNLLLEVDGTCKISDFGISKRSNDIYANNANMSMQGTIFWMAPEVIDSMVEGYSAKIDIWSLGCVVLEMFAGKRPWSNEAAISVIYKTGKEKLAPPIPDDIAHLVSPVAESFINRCFTIDPKDRPTAGELLNDPFVNTLDHDFNFANTKLAEMIRYNSKRLFT

SEQ ID NO: 20507 - protein, 323 aa, Candida albicans
IYFNMSRKPRRHNETKSTPDNGSDGIDLFPFTTEDCMEPQKIIDLFEVCFKHVLESPDLQEHIQVVKGDLYNRDYLAAFNNDDNRFAYACRWSPARALAYSSVLASLEPIKTLLEDPETVRNVLCVGGGASSELVALGSVFCRLKEYHPNSPSQLNIKLIDIADWSKVVSNLTTYMKDSWVYHSEKLNSQFICNDILTSSPESLNLESLDLITLLFTTNELFAEKRKETIKFLQLLNSNCRQGSLLLIAESAGSYSHIKIGDKNFPVQFLIDTILVGKPGLNNGSWEIISQSDSSWYRINQKEVDYPMKLENMRFFYRLYIKK

SEQ ID NO: 20508 - protein, 172 aa, Candida albicans
LRIFQRRGGPIIFELITGDFLFDPHDGKCFDKDEDHLAQIVELLGDFPNDEYLLNCKLTGKFFKLNPNPDLKGNLQIMFKNIDQLKIWKLKDVLVEKYKFNKNDYEVDLICDLILKCLKYDLNERYDANSLLKHPWFDSDNNSTISPGLEDRLKNLPNCHDDLPGYTCECKI

SEQ ID NO: 20509 - protein, 576 aa, Candida albicans
RMKVTTSDIHHPGHQHVIQLLDTFTHKGPNGVHVVMVFEVLGENLLGLIRRYKHRGIPVVFVKQIAKQLLSALDFLHRQCGVIHTDLKPENILIEIGDVEQIVKLVEEENLQRKLQRKLSRTASKTSTPISATPNSSFSNHANTTTTTTTTTAKKISINDSIISPNTSSTALTSSNSFINHSPSLGRSGRRTRRTTLITGSQPLPSPLRSFNKSFTNVYGLSSSTTNTPVRNISINSNNFSFINNSNTTANTTTNGLATTTEDHEEDGENQTLNNSLSSMSITNSHSNSNSYQPTATTNVDPVQIPQESNYSLDDSSANVVEDIINDNELISVKIADLGNACWTNHHFTDEIQTRQYRAPEILIGYYWGALSDLWSFACLIFELLTGDYLFDPRDGKSYKKDDDHIAQIIELIGPFPNQMLKESYYAREFFNSRYELRRIMKLKPWGLQDVLIEKYKFPLNDAIEISEFLLPMLKLKPEERADAGGMLNHPWLRDALGLENVVLERPVGGSGEDIPGWSREISTTTQQSMSSNNHNHNNTHNNNYNHQSDQELQLQQSRKYSNASSFGHKSQPFYH

SEQ ID NO: 20510 - protein, 61 aa, Candida albicans
YTAPIEYMPIDDVETLDRYRPGGYHPVTVGGQLGGRYSIVHRLGFGSYSTIWLARNQDAGR

SEQ ID NO: 20511 - protein, 788 aa, Candida albicans
NPEHILLDDTMRIQITDFGTARLLEQKNDESEEYPVDVRAKSFVGTAEYVSPELLENKYCGKPGDIWAFGCIIYQMIAGKPPFKATNEYLTFQKITKLQFAFSAGFPTIIRDLIKKILVLQPSRRATIPEIQKHYFFQSVDFKDFDLIWLSDPPEIGPYKMTAKSMMKVPELNKAPITTVIKKNVKKSTNSNSNTNNVATAVGGGSSNGHKGSSPTPEKEPSPATINNKSTEKVSAASVAAYVLNKPATNQNSSTSEDSSKRSSNSNETRKLSYSQQDYIPGTNILRPQISTRPSVGSYVKTTPSKDRKTLTKVPLNIHQQQEKVKPKVMEVKPATTLEAAWEPYLTHPDERILRIGPVIAHKEPTEPFEKKNKASLHISHLDINKEQRSRSNTSLLTQIVNEVNNNTSELKKVENADESLAIIEPQYNMKRSPTSDSKKSMDIERSASTSGSRISKKAIFKKLGFSHLEKNDTEESNGPSLTEKPQTCTLVVTTHGRALLFIRNDIESNYLLIAEIKLKYPFIHFQELVISQNKFSKLVPSVGVFVISSIDNSLIFEVEKFEVNQWTEALAKSKYNEIERGKLAAYESQVSLKEPVVITKQSSSTYNSTRSSPKLLDAPAFDSSVAKTNNHKKSQQHSSPTVRKSFETSSPSSHSPRTAATNMFKMKLQSGTPKRKPPPPVSPPQELNSHTGLPRRSTENGTLHAAQLAVSQVSPKGYSNNRRSSFTKEDGSKIDPNKMRKAAHTYNHSHSHNGNNGNSNSNSNGNKSGSGVTALNSKFLARSTRKK

SEQ ID NO: 20512 - protein, 281 aa, Candida albicans
  UNSURE (14): Identity of amino acid sequences at the above locations are unknown.
MSLFSLAQRCGDSXTNQKFYEFKVLKDMGEVAYGKVVLAQHTQDPLYKIIIKCINKERILVDTWVRDRKLGTIPSEIQIMAYLNSEPHPNIMRIIDFFEDSKYYYLETPIFGDPPAIDLFDFIEIKKDLSEVESKFIFKQIVSSIYHLHKNGIVHRDIKDENIIVDEKGVIKLIDFGSAGYVKQGPFDVFVGTIDYASPEVLGGEKYEGKPQDIWALGILLYTMLYKENPFYNVDEIMEGDLRIPYVISETSLTLIKKILVRDVDERPTITDIMEDEWLQI

SEQ ID NO: 20513 - protein, 933 aa, Candida albicans
  UNSURE (635): Identity of amino acid sequences at the above locations are unknown.
DSNARPNRSSRLFTSSPTFANYNNKPPTPSANGDDNGNSDIEDILKFPIESSHAYSYAHLSPNSLALRLNVLKRSLEILKDRPELFKSLTTTNSATNSPVQSSAPPTATSINISIDEASPLFRSASHPVEIDTNMSTEDLSLQPPPLRKTLYMQTNHSSDYIHDVSGASSLSANEHKNYKLRSNASSAALAALFRPTMKRSDSLPLNNNTSIPVTGRRVSTPPLVRELPTSRKTSSSKNKNDDFKDIIDLLENDLSALLDNSEVATTLHDLSLSTPDNLDDTNSNHDILKHKLLHALAMPFIENSVQPTSLLEFDGTSDPSLNSSHVRPSTTALNLLNNNYDEPPAKNRFNNNNNNNFKNSAASRPFHSLLTTKHALPQSVFTVDKDLPFSVKAANDLACLMFGVLKNTIKALTLMDLIAPQFRDFVLKRITGVQIMENKKNRDRILFAGEIVAIVRPGDQNYSWTSLWAKRKGNLIICMFDQIPCDAFDVVILSEKDVIDYKIDSINEIAGSLIEDYGIQNLSSLNSLSYSLNKELLEFHHNNEAEQDAIDETDQTNHTNNTNRDSFDIDEYYDEDIELINQTRYYTLQLEDENNVPCAITSTPLELDQEKHEIKLKIHTMPYIAGIFVIDSNXYKILSCNNAIARDLFGKSFDELENHSIDELIPNFTKILHAGIEATSNYAYQLSPGLVLPEHFFRKYDAFIKKQQNPENDQESKETIFFNSKGIEAVHRDGKVVYIDVQVRVSTNNTLVVWVTYSRTNKNRTNISEELDKLSSASTSSSISLASSNKSAVSLSSISKPRTYSSGLQLSDLKQQQQPQHLPLLLLQFLTKPSQQQSANLLQNIGGHERKLTTTSTVPSQMKLFNNEKENDLLEFSPREITRALSTRKPKKETSLGIPLTRLDSHIYDKNGREQLNLQRKEDKRPAEDLLN

SEQ ID NO: 20514 - protein, 362 aa, Candida albicans
SLYLTMSTDHHSHPVEGHQFKKIFNRLSGQPESYSRKQNYTFGKTLGAGSFGIVRYARDNSTDEEVAVKIILKKALKGNESMIIDEMQLLEQLNNPHIVGFRDWFESKDKFYLVTQLATGGELFDRIVQKGRFTEHDASLVVLQMLEALEYLHNKDIVHRDIKPENILYLTSKDDSPIVLADFGIAKRLQNPNEKLTSSAGSFGYAAPEVILGTGHGKPCDIWSLGVVTYTLLCGYSPFRSENVQDFINEVKHNNAVIFHADYWKDVSKDARRFIIKALQFNPDNRPTATELLNDPWLVSIAKEYKETDLLPNFKQGFDAKKIFRQAIELVKLNNRIKTLTEWQTDEDDDPTEINLFNEHGS

SEQ ID NO: 20515 - protein, 486 aa, Candida albicans
LFIYSYSYSYSYSFHSFIHLHIYIYILSYLGFTISLYRIYFFLWINIYYHMPFKNIFTSSSSSSSLNEDNVIKSTSSHRTILKQRDTSSLLASPQSTSSRINNNNNNHPRNSNNNNINTDHPMHIAPSINSNMSQSSLSTAGTTGTTTINNNNNSTTTHSPTSTKSHRGPSLRRFFKKFKPRDHHDKSLSSHQQQQHHHHHHHHYEKQKHFGAGKPAPINSNATNLFAKYGSPGKLLGTGASGSVNLLTSKNDPTKIYAVKKFRARMTNEQESDYKIKVANEFKVGEMLQHENIIKTFELIKDYSNTTKQIIDPDYYIIMEYCQYDFFNLVMSGLMETKEIYCYFKQIINGVAYLHSKGLAHRDLKLDNCVVNKFGILKLIDFGSAVHFRKEIPKGYYITSDDIMLAPNYKLIRARGVVGSDPYLSPEVFEPLGMGYDPRGADVWSIAIIYCCMILKRFPWKLPKLSDPSYRSFAGPQLNNHNHHL

SEQ ID NO: 20516 - protein, 466 aa, Candida albicans
  UNSURE (412),(413),(414): Identity of amino acid sequences at the above locations are unknown.
ILSPPPSCYLLFPFIMPDRHKLKLFGKNKHDKDDELSLSTSNHSHGSTRKFLGFHIGRHESGDSLTSPVMSNSSESHHHSHHPHQANSSANHRNPSPVHSNTGTATTIPSIQSPQPQASGLHRGDSDKKSSGSVVDLKKFFKTKKTSNPRKEGHSILGQYSNQLHSPPPMAQVHSPGAGSGNGSALQSREQSSTSLATLINQTSSQLLYNASHSVNSNRDPFTDDNSPLVKKYGKIGKELGSGAGGSVKLITRPSDSKTFAVKEFRAKRSTESLKDYTRKCTAEYCIGSTLRHPNIIKTIDIIHENNRYFEIMEYAPIDFFAVVMSGEMSRTEINCCLKQIIEGVAYLHKLGLAHRDLKLDNCVITNERILKIIDFGSAVIFKYPYEQFGNNNSIQPCHGIVGSDPYLAPEXXXSPNSYHPQPVDLWSIAIIYCCMTLKRFPWKIPIREKGYSFRLYCMYEDNSQD

SEQ ID NO: 20517 - protein, 286 aa, Candida albicans
RRFSTLSSPSIIINNNKYRIIRLLGEGGFSYVYLVSSQSQPSSQYALKKIRCPYGIQDESFKNAVREIKNYHRFKSPYIISSIDELIQLETDGSKNIYILLPFFQKSLQDIINELVLNNSKMEESEILRVFIGTCRGLKVMHNHKKTATSTTRLDDDEQDVLLPTSEDDEYEDFTNSTDNNNNNNVQMQELVPFAHHDLKPANVMLSAEGLPVLCDLGSCSRARISVRNRQQALTVQEFAQEHCTLPYRAPELVDVATNCEITEKTDIWSLGCLLYCCCFGYSPFE

SEQ ID NO: 20518 - protein, 438 aa, Candida albicans
DQYILSLSSSFSFQLLKKVILFNTVSVLSTKTRMTSMEPADTSIRSLNDINLQELANKQHQRNINAQGSHTLEDSITSNGNDINNPNNNINKTNNNSNSSLSLTKKTSRHINKDTTTKGKYTLNDFQILRTLGTGSFGRVHLTRSIHNGRFYAMKVLKKQRVVQMKQIEHTNDERRMLKLAQHPFIIRMWGTFQDCHNLFMIMDYIEGGELFSLLRKSQRFPTPVAKFYAAEVFLAIEYLHSLDIIYRDLKPENILLDKNGHIKLTDFGFAKEVQDVTYTLCGTPDYIAPEVVATKPYNKSVDWWSFGILIFEMLTGYTPLYDPTPMKTYENILNGSITYPDYLPPDILDLLQKLIVKDLTQRLGNLQGGSDDVKNHPWFKEVIWERLLSRDIETPYEPPITSGVGDTSQFDRYPEDKDLDYGISGVEDPYRDQFQDF

SEQ ID NO: 20519 - protein, 403 aa, Candida albicans
PSPFLMVNLLKKLHITKLHQLNHSNSDSNSLNSNTSMDNHQQQQQLQQYQQQFQQPQQQLYPGEQIVHPAAAQTGQNTTNVTAVSSSNITQSATSSLHSQQLQHVDVSKSAAEEAIRRSLLPERSTVSKGKYSLTDFSIMRTLGTGSFGRVHLVRSVHNGRYYAIKVLKKHQVVKMKQVEHTNDERRMLKLVEHPFLIRMWGTFQDSKNLFMVMDYIEGGELFSLLRKSQRFPNPVAKFYAAEVTLALEYLHSHDIIYRDLKPENILLDRNGHIKITDFGFAKEVSTVTWTLCGTPDYIAPEVITTKPYNKSVDWWSLGVLIFEMLAGYTPFYDSTPMKTYEKILAGKIHYPSFFQPDVIDLLTKLITADLTRRLGNLINGPADIRNHPWFLDLHHECRIPHI

SEQ ID NO: 20520 - protein, 951 aa, Candida albicans
LHNLMIFIWKLLHRKISQIGNYKIIKEIGEGAFGKAYLATHILLNINVVLKCGLIDDPNIVREIYYHKQLKHKNIVSLYEVIKTENHLWIALEYCQGGELYYYIYEKKRLELDECRNIFFQIVLGVKYVHSLNLSHRDLKLENILLADQKRTIVKLTDFGFIREFNPQSRKFLSTICGTTVYMAPELLTGQKYSGFVIDIWSMGVILYTMLNGMLPFDDDDEMKIQHKVINTEPMFYDHVPIDVNQLISKMLLKDPNQRPSLNEILNSSYLIDVYNKYLEKGTKRNSSGSGDAESIISINQHYDSVDRPFEAKIEKDLLRKLQRISFDTEELKATMYNNEINLLTAFYELLLTQEYSKKKQKYMREKKRKLYEAKKSLKKSRKRVKSVLSLSDQALGSQPLERIMSSLSIASNKNSSRHTLTIARKSLDKNDTTQIPPLPKSSQTSRLNIEIPSPRATNTSIALPPRSRRGSREISTTTAASSITADLNTPLRRTVSFVPDGRRLSQVISSEPKETIKKTNKSGKILHKLQFWKKNKGDEYQDDTISHYSTKSNHSKSTNDVMIESDGENPLELIVKGGNNSPIKFDNTMNSHQKMNTVPPEVLEQQRLDRFHKNDATRRQRENSNSDGQSGKLERPQQLQLQHHRQLLQLQSLNTGLSTSGIDSPHTPPSAENSRFARTRPSSMISQISQLSKLSQMSTMLSESELDILDETDTMDDDDDYDDEVYESSINTSQDNKLTGPNATPSSSNQGVKTSSKKRPTYRRGVASDTSITSTPSASGGGAGGGSGIISTIPKKKNSLSKLRSNSSEDISEDSYRFNDENMPMGRSGSPDLGKKRSFRALQQPIPLVNGTTSTSIAEKLNDATKMPYVRAPSPPIGFKYNAKANKKMMTTAINGNNNNNNNNQQQPPGYQDTKQVEDWIHNGTTGNTTTFTKSTIYQPVINEEEEENV

SEQ ID NO: 20521 - protein, 182 aa, Candida albicans
DKNDLMKTSCGSPCYAAPELVLSQTAYEGRKVDIWSLGVILYAMLAGYLPFDDDPENEDGSDIIKLYHYICKTPLTFPEYVSPLARDLLRKIIVSDPKKRISIDDIRNHPWLSSHANLLSIRQPEWDKVHSEKQQPIAVEPPQPNKRYSMINERTNSSSLMSPAPRVTHTQPLSSHARSYSS

SEQ ID NO: 20522 - protein, 857 aa, Candida albicans
NHSLYLNINKSKTMEHPPAALRTFSTQSTSSLNSVSTVSSSRIVSLGPVNINNFNKPSTPKDHLFYRCESLKRKLQKIPGMEPFLNQAFNQAEQLSEQQALALAQERSNGNGHSNGKRHQSLDGAMNRLSVGSDSSSIQGSLTRMATNASTSSLISGMPNNNTLFTFTAGVLPANISVDPATHLWKLFQQGAPFCVLINHILPDSQIPVVSSDDLRICKKSVYDFLIAVKTQLNFDDENMFTISNVFSDNAQDLIKIIDVINKLLAEYSNASDLGGGDEDVNMDVQITDERSKVFREIIETERKYVQDLELMCKYRQDLIEAENLSSEQIHLLFPNLNEIIDFQRRFLNGLECNINVPIRYQRIGSVFIHASLGPFNAYEPWTIGQLTAIDLINKEAANLKKSSSLLDPGFELQSYILKPIQRLCKYPLLLKELIKTSPEYSKQDPHGSSSSTSFNELLVAKTAMKELANQVNEAQRRAENIEHLEKLKERVGNWRGFNLDAQGELLFHGQVGVKDAENEKEYVAYLFEKIVFFFTEIDDNKKSDKQEKKSKFSTRKRSTSSNLSSSTTNLLESINNSRKDNTLPLELKGRVYISEIYNISAPNTPGSTLIISWSGRKESGSFTLRYRSEEARNQWEKCLRDLKTNEMNKQIHKKLRDSDLSFNTDDSAIYDYTGISTSPVNQSTQQQYYDHRGSHSSRHHSSSSTLSMMKNNRVKSGDLSRISSTSTTLDSFSNNLNGSPNTTNPSLTSSDATKTIPTFDVAIKLLYKSTELSEPLIVNAQIEYNDLLQKIISQIITSNLVADDVNISRLRYKDDEGDFVNLNSDDDWGLVLDMLTSEDFYQTSSNEKRLVTVWVS

SEQ ID NO: 20523 - protein, 135 aa, Candida albicans
MPVETHSDFQVIKLVVNVKGKEPFDVPVKGADSITVTIPGGVKYHMTMHFQVKNKKYEDLRYIQVAKKAGITIRTRELEIGTYEPSEETVYTKEFPEDETPGSWLARGIYSCNSTYYAGDEELFSNDWNLEIVAK

SEQ ID NO: 20524 - protein, 206 aa, Candida albicans
IEKMSNSNVDDDLVPEKVEGYTVGEKKTIDEYKNLDAEDESLAKWKASLGLTADTKPYPVKPGDKRKVVVTELALEFPEQPDLQPIRINLEDSDGNTIVDKEIKFNIKEKSIYQLVVKFRVQHEIITGLKYLHLVKRGGIRVEKVEEPLGSYAPNTIDKPFYERKFAEVEAPSGMIARGTYSAISKFIDDDDNVHLTVPWSFSITK

SEQ ID NO: 20525 - protein, 199 aa, Candida albicans
YLVNCDFIKQFGIGNNYNIYKMSSTLQNSITVAPVGKKTREEVLANFENDLVRFESMSLKLYGHDQPLQFSRDMVPFPQRLHFRLPEYSIYLLTIRFKVKQRPLRNLTYHQTVKKKRIPVDDRNLEMKEEASVNNLDDEDDYHEVTFAPSGVPGGTFLRGKYKARSLVKENGVLIWSYKWTLEVIKKGSTPEIGGFGDQ

SEQ ID NO: 20526 - protein, 304 aa, Candida albicans
PKKRSYFPFRTKTNSSNDEPEDQHSQHSHPDNNNHILLPHTGMINSQNTYTQQQYLQQYQPSGYPNGHQQQQQPSSSGFSGSVDNMQQYLSQMKLDEDSAKKIFGSELEIAFELSNHEFMGRKIPSICYRCLDFLMKTGAIYEEGIFRLSGSASSIRQLKDQFNTRYDVDLFQSSLKPDIHTVSGLFKSYLREMPTPIIGGNAVNHLSALVSHNTYQQQQQATGMSNSDLAIVFRDYFNDVNNVDQIHYDLSFLVFSFLRQIIQQSDINRMTLKNVGIIFEPTLNINVEVLCIFLVEFDTIFGV

SEQ ID NO: 20527 - protein, 274 aa, Candida albicans
RHNNHLLLPNTGMINSQNTYTQQQYQQQYQPSGYPNGHQQQQQPSSSGFSGSEDNMQQYLSQMKLDEDSAKKIFGSELEIAFELSNHEFMGRKIPSICYRCLDFLMKTGAIYEEGIFRLSGSASSIRQLKDQFNTRYDVDLFQSSLKPDIHTVSGLFKSYLREMPTPIIGGNAVNHLSALVSHNTYQQQQQATGMSNSDLAIVFRDYFNDVNNVDQIHYDLSFLVFSFLRQIIQQSDINRMTLKNVGIIFEPTLNINVEVLCIFLVEFDTIFGV

SEQ ID NO: 20528 - protein, 151 aa, Candida albicans
  UNSURE (133),(147),(149),(150): Identity of amino acid sequences at the above locations are unknown.
YYICRFLSLDFVNPLEDFKRGARKEGFLVRRNKGLGATWKIRWCQDDGPNMEKYENPGGSILEQIQLTGAQIGRQSSDAVAEDKGYRHAFLIMESLKSSKLHSSVPKHFFCAESNEERDDWVTALIAFTRGFXYTSGTRQIRELLYXTXXG

SEQ ID NO: 20529 - protein, 187 aa, Candida albicans
LFFILIYPCYFYRFYMKCVLSVRFYYLQQSFILTINFIKAEKLSEQQIAEFKEAFSLFDKDSDGKITTKELGTVMRSLGQNPSESELTDMINEVDVNSDGSIDFPEFLTMMARKMKDTDSEAEIAEAFKVFDRNGDGKISAAELRHVLTSIGEKLSDADVDQMIKEADTNNDGEIDIQEFTLLLAAK

SEQ ID NO: 20530 - protein, 307 aa, Candida albicans
YRYYQDFYDLQVKLLELFPYEAGRIENSKRLIPSIPGPLINVNDSISKLRREKLDYYLSNLIALPSHISRSEEVLKLFDVLDNGFDRETDAINKRFSKPISQKSNSHQDRLSQYSNFNVLQQQQQQQQQQQYAHHSRGSDNSHTNESSGSNLINYYSHNDSSLSSSPPPPQTVTTTNTTITTDSSSKQPKVKVKFYFDDDIFVLLIPTNLRLQDLKSKLFKRLELDITYKYEKPDQQQKPTSESIHLFLKNDFEDFLIENETSNNNNLEIDFENEIIKEKLGEFEVNDDEKFQSILFDKCKLMVLVY

SEQ ID NO: 20531 - protein, 325 aa, Candida albicans
QMIKTFGKSKRLSSNSSSPKKTISRVSSTSSNHTSHDGILQSPKKVIRALYDYEPQGPGELKFFKGDFFHVLDDVDDELHKEAEANGWIEATNPMTQLKGMVPISYFEIFDRSRPTVTASSNSFTNSIDIQHQHQHQQGIHNGTGNRNLNQTLYAVTLYEFKAERDDELDIMPNENLIICAHHDYEWFIAKPINRLGGPGLVPVSYVKIIDLLNPNSHYTSIDTSRRSQVIQVINGFNIPTVEQWKNQTAKYQASTVPLGSISGSGTPPTSANSQYFDNHTMTSNRSSLGSSISIIEASVDSYQLDHGRYQYSITARLNNGRIRY

SEQ ID NO: 20532 - protein, 370 aa, Candida albicans
KREEREERKRKRTEKQDLPPLPFPFPLPIMSKLRQHSITTSPLIISSPTFSAPIRSLTISNPQQSSTILSNLRGNVILVTKYDFVAEGENEISVNKGDLVKLIDRLGNGWVLVKYIDRVQPPGLIPASYVDIAVNDQTNPITLTWLQKDDDDSEQQPTSQAHIDNIIDELNYLDLQFNKVESKFVTINNRPYPIQASISNFLLFNGRIWYRLDIEYSDKSKSYICRYYQDFYNLHIKLLDLYEILSKIEARNSVSNSGGGGGGGSRGDTIKLPKLPEPIPTQNNDDENKEISMLLKRCNELNIYINKLILNKYYQTSDQLRDWLEVRDLPGFIINSFDNEDEKDEQIDEMTNDEINEKILPGSINIVKNY

SEQ ID NO: 20533 - protein, 154 aa, Candida albicans
FYLEMGTTMDAIYVVYFQHLHEYINGENNTKGGVVPVLDHIKLEASVQVWWRTYTPPSWILGSNSTETTHLGEKLNDNIFINIVDCMGADSKEVQQILQTISTNKPVYLITPIASFKHFDESRFSPVWNYTFHLDLDHLDFADIQPGLGVYQLL

SEQ ID NO: 20534 - protein, 193 aa, Candida albicans
  UNSURE (180): Identity of amino acid sequences at the above locations are unknown.
ALIIIPLVMIKINFNWRTFYLLTIVFRFVFTLSDSYIHPDEHFQSLEVLTNRILNYSTNIPWEFQDDPARSLAPLYFIYGPLLYFIKFFKLNLTALQIWYIARLQISILSWIITDFCLYWMLPSKPERIKAIFFTLTSYITLVYQNHLFSNSIETLLLLVTILLIDDLRYVQESKDQDVXNLNKNKNYSILGC

SEQ ID NO: 20535 - protein, 270 aa, Candida albicans
NMSIPFGVDLGNNNTVIACAKNRGIDIVVNEVSNRSTPSLVGFGHKSRYLGESAKNQQTSNIKNTVDNFKRIVGLPHDHPDFEIEKKFFTIPLIKNEVDGGVSGKVKYLTKNHEFTATQLLAMYLDKIKDTALKETKGNISDICLSVPGWYTEKQRRAAADACKIAGLNPVRIVNEVTAAAVGYGVFKAGELPEDEYKKVAFVDVGHSSYQVSIAAVKKGELKILGSAYDKHFGGRNFDFAIAEHFAKEFKSKYKIDVHENPKAFYRVLV

SEQ ID NO: 20536 - protein, 169 aa, Candida albicans
  UNSURE (168): Identity of amino acid sequences at the above locations are unknown.
LEWSATARFLLNFFAIVPLASVLAFATEEISEHVGQTVGGLLNATFGNAVELIVSIIALKDNQVRIVQASMLGSILSNLLLVLGCCFVAGGITRVQQTFNQTVAQTMSSLMALATASLLIPAAFHASLPTPKKGGGFPEPGSSDELILSFSRGVSVSCLHLGYGPDRXK

SEQ ID NO: 20537 - protein, 454 aa, Candida albicans
TLLLILIFIFIFRTMAPRTPADKLGHACTLQLPTYDNDDQSSTNSTTPLHKDTPEETTDTSTTTNDVEPFHPPKLLSKTTTSPSIKLTSMLSKTSTKQNPNFPISLQSLSELHDPKSLKQLYDLGGIDNLLALLHTSFDGLNEHNETDLSQRKQYFGINRLPQKVQKSFLKLCWEALKDKVLVILCIAAIVSLALGCYESFGSGTHYDDEGLPLPKVDYVEGVAILVAVAIVVLVGAANDYQKERQFGKLNAKKEDREVIVVRNGGEQKLISIYDLMVGDVINLQTGDVVPADCILIQGEVECDESALTGESHTIHKVPVAKAMKVYQNHLPTNEDIGSTQIKFRDPYLISGAKVLSGLGNAVITAVGTNSIHGRTMMSLNHEPESTPMQVRLNDLAEGISKYGFLAAIVLFVVLFIRFCVEIAPNGNMNGAEPADKGKRFIDIIITAATIVVL

SEQ ID NO: 20538 - protein, 450 aa, Candida albicans
KSCGNNGGSNRQFVSDKMVLLTENKMRIVRGFFGLNKQGQPLEFNDTVGNQHDEPTSIDIINNEISSEQKVYLTTNIILNSTAFENSEYDEEKAKLARQKPPKQSFFSSLFKNSKKSQYQQMGLVDEPYLGNKTESALLTLAKDKFHLFDNKSLETCRQENNGDVIQVIPFESSRKWAGIVMKIPNGFRLYVKGAAEIIFKNCGFENNINDELIKLDRSKRDDVLSKIDEYANDALRAIALAHRDFVGISSWPPSELSSSSENKKTTTTAKEADPAKLINTSSSASEIHKMFILDALVGIQDPLKKGVAEAVLQCKRAGVTVRMVTGDNINTAKSISKECNILTLDDLSNEYSCMEGPQFRKLSIQKRREIVPQLKVLARSSPEDKRILVDTLRKAGEVVAVTGDGTNDAPALKLADVGFSMGIAGTEVAREASDIILMTDDFTDIVQAI

SEQ ID NO: 20539 - protein, 75 aa, Candida albicans
FIYSPNMSETLGDEYYPSFAPFLGFAGCAAAMILSCAGAAIGTAKSGIGIAGIGTFKPELIMKSLIPVVMSGILS

SEQ ID NO: 20540 - protein, 459 aa, Candida albicans
MLFQTTLTPEQEECPITVRLEASASSIVRGCPGIPRSIPRIETVLNIRSINHSPFPLRSVSIKLMTKQKVMIPTKFGSSEAFKEFIIYEDPLTYQPPMGEFSQLLHGLDIPILIPIPKDLTPTGHSPTLGATTIHNLVVFVSLGNSASTESTFVDYFPVDIKMYDTLPIYRQYNEPIVESRYSSDNQTLVEVAIPVTSIGPGDNLKVMCTVKTNSANNKVKKHIALKQLTFQVKEILECFDGGLPPRKEFKLHTESKAFAKEINTQGTSQTFSIQFPYENEYLEMFTPKEDGSSNNTDITESFSTTIIESKNISKLKVLDKLPDGVPLTHIQGFTLLGKFYSIWFEIVIKVKLSHAKDIDIHIPIIVCPFNKESSTYILNWIMAECEVAKREFGKEFNRIYSSTSKYLEMVKLIDRFRQPPVVCDNGKIKGITDPIPNKLLPNISSNSNSNSNSGLCID

SEQ ID NO: 20541 - protein, 447 aa, Candida albicans
TYKTIHLSMSGVSDFLSKGIDLVQKAIDADTATRYEEAYKLYYNGLDYLMLAIKYEKNPKSKELVKSKFTEYLTRAEQLKDHLEKQAQNKSTAESSVNGSTKAKKSNGDSNGSGDDNDDADTKKLRGALAGAILLEKPNVKWSDIAGLDAAKEALKEAVILPVKFPQLFVGNRKPTSGILLYGPPGTGKSYLAKAVATEANSTFFSVSSSDLVSKWMGESERLVKQLFTMARENKPSIIFIDEVDALCGPRGEGESEASRRIKTELLVQMNGVGNDSQGVLVLGATNIPWQLDAAVRRRFERRIYIALPDVEARTRMFEINIGDVPCECTPHDYRTLAEMTDGYSGHDVAVVVRDALMQPIRKIQQATHFKPVIDETDGKEKLTPCSPGDEGAREMNWMDLATDELKEPPLTIKDFIKAIKNNRPTVNEADIAQHVKFTEDFGQEGN

SEQ ID NO: 20542 - protein, 87 aa, Candida albicans
ISERCGSCRLVKTCGYCEGPDKDIKIFQGITEGKIVDSRGPTNFGWDSIFQPNGFEQTYAEMDKKVKNSISHRYKALDKVRDYLLSQ

SEQ ID NO: 20543 - protein, 262 aa, Candida albicans
DQNSDSKRDSEPGQNYTVTYHSDETLGINHETYQDSNKEKLARGSQISAVKRDISRTNIVILDALSYIKGFRYQLFCEAKGNVTPHCIVHVIAPIEKCIQWNDTKELGNKWDPVLIKQLQMRYEEPNSDTRWDSPLFTILSEDPQEKIPIEDIWNALVLKKAAPPNAATLVKPTSGNSFLQELDKKTQEVVTKILQQQQITPGDVVIDKNLVVAIPTGTASTAQLQRIRRSYIGLNRMRSIEVDRIVPLFVEYLNRSLNSED

SEQ ID NO: 20544 - protein, 564 aa, Candida albicans
  UNSURE (235): Identity of amino acid sequences at the above locations are unknown.
LLNNLILLQLANTFNKNCIIKIVASLSYFHTDNKEKVSKSALFHPNRAFNMSNSIGFEEENDTACDATSKVKQLRSALSLNSSSSRRNSLERMSHDEGISSPTSSINYMSSSSTKSPPPSPPKSPRLENTKKMFKMMSITSPMGSLSESVVLSDSDERSSLELQERGTITPSRHMEINQSSDEDDTEFDSTRLRFSARKGRRKSGTDEESPSKRSIKLSRGASPARKGRRRGSSXSPHSDTNTQGKSSSTSKRKLRRKSKESDKSHRSEFFGTGYTSMPTSGKVFRNLLILEENLREQVIQQRAMRRKYLTFLSILCSIIAALSHHLFFLDNSSTGTLKVILQFCLLATIVTLMLYHLSGEYQKTIVLPRRFLSLTNQGLRQLNVRLVKIKTPFFDKLTDLIREILLAIVNFNLSVFHKLSPESIQNKNSKIEVFLVTCQSQCQPRIGVTDVKLVLNARVFNTDIREGWEMYRSEFWINEGIRRRNNMLSFISGSPVAKPVGLKRRKRKSENNDSSIKPKSIPASLSEQNLQVLSSGFEYNNDNNVDLRSETSSPLRSDTLVSD

SEQ ID NO: 20545 - protein, 248 aa, Candida albicans
DKILYRKKYTLFLFFFTTNLTPMLSNDSADYRNKFWSSTSRQVGTSFQPLGKEESYANRYPLVRSETFPPTKDETPYSSIDSSANKYMKNTMINAPSYIPYYRKDDSFEMLQEDYNKLKGELILKNQIIKNLTDQISIMTKTDQPPTFTAPKNHYQLFQDLLKTLQEKSTELQETNQRLEAVLVANSENYDVEELSHKLVHRLTQLQQENENLLKIISFGNKTNLLIEIGLLKHEIELLKKGKDGFVL

SEQ ID NO: 20546 - protein, 98 aa, Candida albicans
  UNSURE (2): Identity of amino acid sequences at the above locations are unknown.
VXTKLKIIGGALELIGNIKEISLKNLKLVKGSAIVKSTSSIFDCKKWSKTEIMLVVRGGRIECTDSNNEKITSRTKEDGTGGELITTPTSTTTTITNI

SEQ ID NO: 20547 - protein, 201 aa, Candida albicans
RVKNISGREVIIGNIIISEFDYPIITFSNLEKLLGNLTILKSPDTVRIDAPIMELISGTFKMIELTSLALISFPALKWVNTLHWKILPILSNVHFNNEIKGIDNIIISDTSLTGFSGFLAESIENLDINNNRFLDTIESNVETISGELHIGANSNDVKVSFPKLKQIGLLNINDVEKLNLPELEFIDDSLILNNNNFQQLK

SEQ ID NO: 20548 - protein, 513 aa, Candida albicans
RQGCQSSIVKQFVELFRGGRNQHWHPECYMVHKFWNVCITPDSVGLQKLFDLPDDVLNGLKLVKDDNESHISVDSAMLMSIEQQIEQVVLKCWVTLSGYEEITAKCISDMLLCACTGNKFNGIVVTGKLVLNVEVLFNALDYVILMCKSSHELLHKKFGTPPNKDDLESSSTEEEYFQMLKKEPRNITGKIMSYLAILRKSDHIAKSGSLSAELLSVITGCAHYLKLLIRLGLYNALKLNRLYGTTNAIEKFLQLTSEHEAISLLAGDSKTQLSLINSKLTIPASSTDACSSCAKSIEKSCLKLDNNRWHVRCFVCSLCKRTIPSIEASETKFDVIHQSIVCRECPCEHFDTGFHLVSDLSQLIYLLKIALFRSRSVMKVDLTKVPRSYLSDSQSDTDTVDVAQDNYSQTLNDVTSLRSKRQSQKLSKSIKKKARKSIIVEAPEADKARKEDIKTHPLGMKSSGVGTNDTSRSSGINDETTIADELNDLSFDSSHIKSNQDSRKTSSVLTAII

SEQ ID NO: 20549 - protein, 387 aa, Candida albicans
IHSKIRGEHQRQTTNTPLDRTSDLLKNEKSLTLGDIPRIVAAEQARVHAPYAFPHHNSLYRRQTAPHRLKVIGHTSTVITPTGVLDNILYTSQPHPEEPVAVRKQKYYSELTKDEHFIIRHIAVEALSHISKSYSNKEELLSLIQTKKQPTFWDKFKFGGGDGKKDKVMAVFGVDLQVLTKKYGIDSHLGVGPSKLRIPIVVDDIIAALRQKDMSVEGIFRLNGNIKKLRELTEQINKNPLKSPDFSIQNAVQLAALMKKWLRELPNPLLTFGLYDMWVSSQRQVNPVLRKRVLQLTYCMLPRTHRNLVEVLLYFFSWVASFSEIDEETGSKMDIHNLATVIAPNILISKQSSNSSSGILLIPVPIIQIHNKHQGIIISLPLKLLIN

SEQ ID NO: 20550 - protein, 136 aa, Candida albicans
HINFQAIIKLIIRNSSNSGTNNSDSQQASGDNYFLAIEVVNQLIEQHEEFSIIPLDILEFYEKCGFDKFDSTKKEITTRDVMIKIDKELKEKPDYFDNFELKNPTGSLTSQEVKRNSVSRIESKIQNRELNGISER

SEQ ID NO: 20551 - protein, 300 aa, Candida albicans
QLVSLAPFAILNLNQGVQKAGTIVLSDTALTNLNGLASFNTIDSININNNKNISKIEFSDLQTVTDSLILSFNNDDAEVKLDSLKWAGNLTIQDVSSIQASNLTSVNGSLLISYNTFDELEFPNLKSVGNSMQIFAHDELTKISFPKLSELDGELEMFNNTQLEEIDFGNLTTIKGAVTISGPFDNLTMENLKLVSGDFQVNSTSDKFDCSAFDKLHEKGKIEGHNYVCTHPANPSSSSKSGSSTQTGKSDSKSSDGSSSSNSSSSSKKGASNVLVVPGMVLTTALGVLLALIYRREIKL

SEQ ID NO: 20552 - protein, 412 aa, Candida albicans
FQYTNSLLLDSTLTTATPSVKSECSFKDFTATASNQVQQVAACATAVGDITIQGESFGTVELTGVQQIYGSLHVKNATKATTINAATLQLVSGVLEFNANTILSDLNLAQLTTVGSFNLNALPALEKTGLTAGITSAESVVISDTGLSSLTGINVFKLKVFNVNNNDNIDTIDSGLQEVTDTIDISYNAEKVDVILKQLSSAKNIVLQQVNSFSAPNLTIANGSFAVSSCSVEKVELAELTSIGNSLTINKNDDLTELDFPKLKTIGGALQISDNSELRSFSGFPKLESIGGSVNINGTFDNGTFESLKRVSGGFILKTDGKLSCNAFNKLNTNGDIKGDKFQCEDRQTTSSSSSKKSGSATETSGSSETGSDSSSSASGSSSSSKKGGAASNNGKLASVVAAFAAVGVALF

SEQ ID NO: 20553 - protein, 477 aa, Candida albicans
MHNWRNPKNSNNLGGSNNTSNNNNNGLLLNKLNSNSSPSLSNSITEEFKTRLEGVPLNQLFSISSLEVYLRHMANPDNSINNSGGGGSLYLNFFDKLITSNQITPFETFNHPISQIFIIDYETDSIDILRKLIVEFRNYNFPKFFQIDDLLIHVFIIYDCDKFATGDIINFQNEIKNKLNVNTTVFPMSYNNNKEKSLGGGMETNTISLVENSTIEEELQRISWNDINNSFEIPKVVDYTIRTKLYEFINKFLIPHMQSKVRYWDDQILQPKKSITGRFFQVSKKFFNSNNNSDTNLLTNTAKSFKNGVTHGNSNSNSNSTFNYNENYYYKSLLEQILRKLADWSLMLKDFKYAYSTYELIKKDYSNDRAWVYVASTQEMCIVSLLLVQTQQQQLQLQLQLQLQLQLHQQNIKSLIPDKNTLRKIKHDIIEPYMDNLCYTFKSRLNLKTFSFKTMIIVIELLLCIFNRRSKDIERQP

SEQ ID NO: 20554 - protein, 167 aa, Candida albicans
PHRLSKFDISMMTKICHRINLLPIIAKRDGLTDIELIQCKHAINRDILENKIQIFNFLSKLNDDAGADAGADANADHHYKRDGDIEEYMTLSAKEYNYLSELNKSIPFAIIGSNSIVGDPQNEIVRNTKWGSIQIEYKNICDFKILKNIIFETHLLQFKYVIVDNIY

SEQ ID NO: 20555 - protein, 518 aa, Candida albicans
FFFLVFFIETMKSSSSLSLNSNTSSNTTVDTDSFEQKKQQIVKQDPKTIYECIRLIYTRNNSEFLSYRCYNNFEVGNIFNVISKNELNRRYFQNGLTQLKIDDESYFWEKQAEPEIWQGLITIQFDVSDFDYWFINLLATLARVYFQKHQNINDYDVYTKMVANTFASELKHTVENDQWESVGEAFFSKSIDFFTSRWQPLEAVLPAFPCKSSNIEKVAGDMPDKGEELALSRLIQFADSIAKIYPPGIIIWIVSDGHVFSDCIGVDDSKVNRYFQGLQNLYQNLKPKDSNPIRFCSLPEIFKCFGNSGFDVGWVENVTLGHHLHTEIDEQSEFCRKILVSSCDTDCGKLRQDITTTGHPRLSLFRGFSKFMTEDLALHPTTSHLTRKKFKKIVAKIAFEMIKRNDAYSNLVELMFPFHLRFSIHAHCNSGPKFGISLLSKTGDNQCRPINTIQDHKEPRNTDLLHIPTPWHNSVVKIDNCDIYFIIKSNKVEEEIRKGNGSGGWDPNNLHYIFFSNQ

SEQ ID NO: 20556 - protein, 379 aa, Candida albicans
WIHIMRSKVKNSSVSPTTINDISTQSSPGLSTLVISLPESPHKFSNPIDIISKKSSIKSFKSVKIINTLEITSPILNSANKYLKPTTQSNHCTSDLEDSKKAGLNCLPYQCEKNSNVMGGKFSLMVAGARGTGKSSFVNCLFGNELLVENCDTANREFLDINHFELTENGFTLNLQIIETVNYSNFFDKGFKSDSLCAFVDEKFKAFLYQSRQPRRESLIDSRVHCCVYFLTQTVNSISDLDIQTMKKLSTRTNLIPVVAKADMLTEIELHNFKNLVRTTLEKHEIETCQSISNEKLVQEINMKIPLSVISSSSSPLEINNNGKIDRVRKYPWCLLDIENESWCDFHYFRKLLLEENMLEFVASTEVYYEQFRNNFTKW

SEQ ID NO: 20557 - protein, 208 aa, Candida albicans
  UNSURE (23): Identity of amino acid sequences at the above locations are unknown.
FSSRCFDIPGKGEKFLKFKKLEXLINRWGTGSTNLKFFMAIYKFLNIGIRRRLCIVLPILHFLNPFSDYQLRLLIIFLTFVPTFIILTISFELLFYVGFSLILLQWLSIEELLKFSHKDLVETFEKTGKLPKGYWLQVIRITIIGFFFLQLAFFGTGNIASISSFSLDSVYRLIPIFDPFSMGALLMIKLIIPYVLLSTCLGIMNHQL

SEQ ID NO: 20558 - protein, 89 aa, Candida albicans
IKKFTISTLIISTSDFLSLNFFFLVRTEGSWLDIGVSISNYCLAILSSLFMLILELISSVVLSGVEYNSDGTKLDFEPISYIVRKRKVT

SEQ ID NO: 20559 - protein, 284 aa, Candida albicans
SRVLNHSFMGFLKQQNFLIVESFIGMYRGIAYGFFERVMFSIILIIIGLYPLLVHGAHKVSGLMKTIWFITCLLMCTFTNLDPVKIESLFQINVGTILALIVSIMGTKQVFKRTQVGPIQKQLIIAQIAIIPIILFATNISVLSLQARTGLPLYSQILGWITFIVSLIVLPILHFLNPSSDYQLRLLIIFLTFVPTFIILTISFELLFYVGFSLILLQWLSIEELLKFSHKDLVETFEKTGKLPKGYWLQVIRITIIGFFFLQLAFFRTGNIFSHTGPGTIRDC

SEQ ID NO: 20560 - protein, 574 aa, Candida albicans
KINSYITSFFFYLFFIHSLSTQLQNLFWDNFLYIFIMDRNRQLLLVIGVLFHFFYLWSIFDIYFVSPLVHGMDHHKSTWTPPAKRLFLIVGDGLRADKTFQKLTHPRTGEEKYLAPYLRSLALNNGTWGISNTRMPTESRPGHVAMIAGFYEDVSAVTKGWKENPVDFDSFFNQSKHTYSFGLPDILPMFAFGDGVVPGRIDVCMYGHEFEDFTASSIELDAYVFHHLDELMHNLTTNATLNEELRQDGNVFFLHLLGPDTAGHAYRPYSAEYYENIEYIDRKLEEVIPQINKFFGDDQTAFVFTADHGMSDFGSHGDGHPDNTRTPLIAWGAGVKKPIHLQDVSNLEEQLLKQSPENSGFESTYFDTWELDHLVRNDVNQADIASLMAYLIGANYPANSVGELPLGYIDADPVTKARALYANSLAIVEQYFVKEQEVYNHQFKFKPYSPFEEKSIQKYQQEIESLIDQLEKSGSGSKDEIEKKVIAKIEELMKTTLDGLTYLQTYNWLLLRSIVTLGFFGWIVYSFNIFLKLFVLNEDELKIPPEFSVTLVGIFGALAISINYLLFYQNSPFN

SEQ ID NO: 20561 - protein, 436 aa, Candida albicans
FSIVMLSAELKRRKKLLLPLALISGIIVLLFFTNYNYSFTTSSHPVLSSSHKSNNAFPTLDQTSSTKARPNPGNLIANQKDKSQTGTYFTKFIHKDPQFDFTKITYTSTNKKFKTNNIKVDEETGDTTEVVNKPTVLIMSVIGNNEPYGSDRHFDGFMLTILSLVENQPDYEFSLGLLNNNEEEFIKIQNYFEKNLQKELSETLSSIFKSISLISAPFLDQNTGFSREQRHDDHVQRLRRRLIAKSRNFLLLNTLNLEQYVLSLDADMIRFHNPEKFIKTFIDSKKDIIVPRIQRLDMQDYDKNSWRGQRTKPTKEQLEKMDNNQWDQWDYVPRDVKDHMYHFQTYMDNKDNEYELHKEEYDYVVPLDSVGGAVLFAKSIVFKQGVIFPTSLIVGTTWDRQEGYDGIETEGVCYLAKPLGFSCWGMPNVVAHHSGG

SEQ ID NO: 20562 - protein, 105 aa, Candida albicans
VSYLEGHIWQTYGMLNGDPREVIDLDGVGGVSILARAKIFRQGVHFPAFTFLNHAETEAFGKMAKKMGFSVGGLPHYTIWHIYEPSEDDLKEIARLERKKRRQKS

SEQ ID NO: 20563 - protein, 310 aa, Candida albicans
FCSVMIQNTVRGSILRSAKFTAPRSLLSISRSLTTENTSSKPTPPPKNDETTHFGFKTVNKDDKEKLVGGVFSSVASNYDVMNDVMSMGVHRLWKHHFIQRLDAGMRPGSTQPLEFLDVAGGTGDIAFGLLDHAEKKYGDTMSKMTIADINPDMLKEGEVRFAKTKWANTDRVNFLVQNGETMDQIPDNSKDVYTIAFGIRNFTDIQAGLNTAYRVLKPGGIFACLEFSQVENPLLDYAYQAYSFSLLPLMGQLIANDRDSYQYLVESIRKFPKQEEFKGMIEKAGFYVPEPGYENLTFGVASIHIGVKI

SEQ ID NO: 20564 - protein, 259 aa, Candida albicans
PPTFVRPVGWLKKVVHVVAFCFSSLLLIVIFGLIIILFFKYIKTKKDLEGIQLNDSLHEITIHSDEEDNNNNNIDNTNHNNKRASVTINKTIFDLTPFLNLMLVFTFFSVLTTLLAFLADILLFTPNLSYLGWLQLIPIVLMALVTSMLCFIKRSISSRKFFESEYRYANDDMRIMRKTYVDEFWNDNASDDGFYVYTDGFYTRNGDNVQQPTSNTAGSLLSEHHDVSIVEPRTFLDTDDSRRGSSPHEFIELQNLRPV

SEQ ID NO: 20565 - protein, 156 aa, Candida albicans
SYISCYSFFLSFFCFRIFIRIYIYIYIYINNKDIFSKVMPNTLDQSYVEKGAWKQDLFKGKVVFITGGAGSICRVQAEALVLLGANAAIIGRNQEKTTTAAKEIASLRSDAKVLGIGNIDVRKVQNLKEAVDKTVEELGRIDSLIVLLPQRAKDPR

SEQ ID NO: 20566 - protein, 311 aa, Candida albicans
  UNSURE (145): Identity of amino acid sequences at the above locations are unknown.
NIYSYIYIYINNKDIFLKVMPNTLDQSYVEKGAWKQDLFRGKVVFITGGAGSICRVQAEALVLLGANAAIIGRNQEKTTTAAKEIASLRSDAKVLGIGNIDVRKVQNLKEAVDKTVEELGKIDFVIAGAAGNFLCYFNHLSSNAXKSIVDIDLLGSFNTVKATFEQLRKNKGAILFVSATLHYYGVPFQIGVGAAKAGVDALSNALAVELGPLGIRSNAIAPGPIDGTEGMLRLSRSSKDETIKNVPLQRMGTTQDIADGTVYLFSPAASYVTGDVLVVDGGSWQVSSGVGAKDYPVTLLNAINAPKGGKL

SEQ ID NO: 20567 - protein, 292 aa, Candida albicans
IKMPNTLDKSYLEKSVWKSDIFKGKVAFITGGAGTICRVQAEALVLLGADVAIIGRNPQKTEDAAKEIATLRPGAKVIGIGNVDVRKIQTIKEAADRTVKELGRIDHVIAGAAGNFLSDFNHLSSNAFKSVIDIDLLGSFNTVKVCFEELRKNKGSVIFVSATLHYYGLPMQLHASAAKAGVDALSNALAVELGPLGIRFNCIAPGAIGGTEGMLRLSPPNETPLEQKIPLQRQGTTTDIADATIYLFSPAASYVTGDVLVVDGAWWQVGGFLGDLYPSLVIHQNEDPQGKL

SEQ ID NO: 20568 - protein, 317 aa, Candida albicans
FHLSSFFFALLYLFHSFFVIFRNLKNNKRNLLITKFMASIPELLSFLLLVCFLTVLDILRSLITIMSANNNNNNNHNNNSNALQNPVSPKPTEGNSKQESENTVTNELPTFQHLKHYPLVNSTKSAIELIPLSKSVFSIMGNSFSFVRSYQPMKYIVGRSDTLTNRALDEIDKWLPSLQTVEVQDITTPITKPVNDTVETVQNTITAVNGSVNKNFVDPTKSALGSVKEEFQNHVYDAEGKGIISSQADPMVAPLNHTLEQFVDNHFPNTKKVPTEGHASEISRTFKIVGNLISRGEKEKEKEKESLDKSKPEKTKS

SEQ ID NO: 20569 - protein, 388 aa, Candida albicans
SPQKIYAHTNTSVANTYNFTKFHFYTTPIMPSIEQQLEDQELYLKDIEQKIFQTLSKINKTTLENDNDFRKQFEEIPQDSNTTESNNLTDLTITELNNKFEIVTDNLQQLNELQEINSKLKEIETYLGKPKTLQSILDLQYLNNLFKQIIIDTNSQYIIYKQIKKRVDSLYENFVNQLNEYLTILLIPDPLTITNIAILQDFNRFLLKNGHNNMNAYDKYKENWDKLVDSILGDSTPTPSKQLSLIVDELEDTIKLEIVSDNEDNNFIKSITNLIRFINELQYPIIKNYLNSKISKNLIDKISININQIINDKQQLNDLDELVKLCHETNWNILSRMEGIRNGGDDSLQEKLNKLHLDWIVDNYVDKIKKIYKSDAIKKTELIDFDSG

SEQ ID NO: 20570 - protein, 234 aa, Candida albicans
PISSPTTNVETSSVFKASPLSNGVKNNADTVTLNSVNIPKTISGTAIDFYQRELLLYKNELEFSRYMKHLNKFYYLKLKQNKQQETVEARVDTKYESLKVVLDETKEKLTKLSTDHDEEKKILIKRLEDLNLEKEKLTRELNDTISKTSSDLLKYDLLIKDVIPTKDYEIENLKLKLSALEEKLKERPEEMHTTDSETTTQSHVEVDVTVYDLRTKLQLVNEKYNQTAHQIISS

SEQ ID NO: 20571 - protein, 142 aa, Candida albicans
DLSLGREFTAIQTDTNRVKIFGKSSIKNIPESTVARVAAMWSSVHILLETNVLQSFGNNSHEQLFPNNSSVAVEEYAIGSEHGLVTSDNIVYAWGWSEHGNCGTSNASDKVTFDYLNKLYTGSAKVVLIGAGCATSWVVVEK

SEQ ID NO: 20572 - protein, 105 aa, Candida albicans
  UNSURE (105): Identity of amino acid sequences at the above locations are unknown.
SAPKSLTDESEAEMYQLLACGSNGNYQLGINNDEDQNSLKVTLFDIDGTMSSEVPGKPMKIAGGGNHTMVILDNGEVFTCGSNEFGQCGLPRGESLGGPDQVPVX

SEQ ID NO: 20573 - protein, 1025 aa, Candida albicans
  UNSURE (9),(11): Identity of amino acid sequences at the above locations are unknown.
LFAGPSSPXVXTKGLDIRDANSLFNTFEIFMPCFDGKETESNWKVREKNILQMRSILRGNSATQFRSELVQCIHTIANGMCKGASSLRTTLSSNSCQLIKECAVILKKSLEPVAESLFPTLIKLCSSTKNIASTNANMSVAALYANLPYTSKMIQRITLASEDRNYQPRSYSLIWLHILLLKIGIDRSYIGHHDSSFIEAANKVFMKLLKDANPNVRQTAKECYWCFTRVFPEDAERLLKRLEPNIVRALERSQRESGGSGIAPIRTLSSRPSRPSLKEAILEKNKELRQRRPPSRNSGEQSTKIKSVPLPRPTKSSSRLEKSLLRPDVGHKSQPAVRASSWTYPSTQSGPKATFKQRERSKTEVHKKSPLEISRPSSRLDTGAVSSFNNKNDPMINFLSSSDSDLIKEGINLLKYAIIGKENLPSEINSLLKSISEKHVQFMKPLFTSNDYTFKKAALLLLPDDFLRVCALVFDEFDEAVISLIIQCIDVLTFYESACNLLTLVADTPNIPGSHALVMQISNQKLTITKLILQALLIALSKHAVTDVQFGEIFQELVKLIIVLKATDYYSLLCQLFRQLYTIDSNKFSLLVEDVEGKLKEEVEFIVGIESTMTLERPSSKLDYDLTVVKPTLNLGTFVLSQKPSADDFTMLLPKRSEFLGSGEVYNSKMVAKIEALDSSPQKQSQMDQISLKRSNSEHQSEVLVDDFANVSIADGGGSKLNQSKNDDDNLKQFMERIDPLKPISNKIRKISIYEDAKQNSEKPKLERNWGGFQYAKFSRAIRVNAVAENMSLTSQEFESCCSKLVETPSQSALLKMTWFVDSLSVSSYDYQEFFLNKGKHKLEKSLWEFFSKIDKLDHSLVMNGLFLLKQLLKFNDTPNVDKLFALLVDTCSQEELDSELYFIWNEMLLSLNHDELMKSFEKNALNYLEGEENNLTILSLCLNYLAKVLVDDNCLDVAKIYRLDTIFGKLFHEREVMFRKSATICYSNLLKNTNVSPEVKDTLDKVKSRYPAYTQRLIEFYMKR

SEQ ID NO: 20574 - protein, 884 aa, Candida albicans
  UNSURE (819): Identity of amino acid sequences at the above locations are unknown.
RVRRGRTWIFTACCRSALYDYDKQTEEELSFNENDKFNVFDLNDPDWILVGDLAKEKFGFVPSNYIQLDSTAEPAQHQQQQPQQVFQPPPQQQQAIPQQQTQIPINNFPPPPTHKDRTPDFPAPPAHRDRSPEHPPPTPEKDYPRMFEQEPRSLGSRYDRQPEGREEEEDEAPPPMPSRPTGSNIVAPEPVVGRSNTYEQEENVEHSEHSYDGEFFTWYIDEVDGRKKRAIKLSIGQGLVIIKPNTTNPKKLRMRSSSSLDNQWRIKDLITFNNEKKHVFLEFKNPAASLELHAGSKDVAEAIMAILGDLKGAEAAHGLREVAKASKASANERNRKIGRLLYDFEVQGDDELDCKEGDEVYIIDQKKSKDWWMVENIATRRQGVVPSTYIEIISTSNLDKLTDGPLRRKSTKSKGRVVETKDKRSSHHRTREERDRIREKDRAQRDKAPTSQTEQDKSMPNFHRVRTWIDSSGTFKVEAEFLGCVEGKIHLHKTNGVKIAVAADKLSVEDLEYVERVTGTSLEQYKEQVMKQQAKRAKSKSKSGATATPSSTNETKYASSATAAINDIAPPKPTRPQTTTQVSNNGAPLYDWFDFFLECGVDIGNCQRYTLNFEREQMDENIWEDISPSLLRTLGLRERDIIRVMIYLDAKFDRKKTPEAPQQNGGLFIDKNGNLKNNSSSTEISKVSADALPSPVKTQVTSFTPVNESTQNNNKIEDDAWAMKPAARSSEDLLKPSPQPQTPQYTGALSDLVNIKPVGTSNENKAKTEQIPVEPSAPALQPMKTSNTAATSSIPPQGPGVTPQRTGTLVPVQKTGGLXPVQRTGAGLVPVQTGGYLPAQPTGCVPITAQPTGFIPIQATGILQPQLTFGIVPLQTSTSTFNAK

SEQ ID NO: 20575 - protein, 370 aa, Candida albicans
  UNSURE (336): Identity of amino acid sequences at the above locations are unknown.
KPHQSVFSAPVSKSAFGQTGFGGSEASSGFGTTGLGQKPEATSAFGTTGLGQKVESKSGSGNSAVIQNPQATSAFGTTGFGQKPQATSAFGTTGFGQKAQTNSAFGSSGFAQKPQASSAFAQSSGSPFSGFAKSGSTSSGFAKLGSGGPSIFGDKTSSPVSTPLADESKELEEESEISLPEESDYSDEEELATDDANTSKDLEEVEGENVTETQEEKVETEIPPPTDPKPVQFSFFSGFTRISKPSSNEIKNKIINIIESTEGNLQVMDANRNQLGDFIGQHEKIDKGIDSLKFAEARVPLRDTTETLKRELLELTNLSTKIQKCFGGKSETRPSXQSIGHGSRPKLCQQRCPQIPAIGFQKRFDANKIA

SEQ ID NO: 20576 - protein, 114 aa, Candida albicans
LTTLYNYKTPTNIETMLSIYIGVYKALYDYAAQAEEELNIKQNDLLYLLEKSDIDDWWKVKKRVVATGEEIVDEPSGLVPSTYIEEAPVIKTATALYDYDKQTAFQTSYSRTDL

SEQ ID NO: 20577 - protein, 273 aa, Candida albicans
RGSFQAVVNIPTVANSNNWWCTPQTSFNQPALVPTQRTGGQITGGFVPQSNFGKQITGGFMDTNTLSFGQQITGNAQQQPPPSTSFGQQITGGLPATSFGQQITGGFPQTSFGQQMTGGAPQTSFGQHITGGNMPNTSFGQPFSQQATSNPFPQMANQFTQQQQYQQQQPVMNQFQQQPQQQQQPFYNQFQLQPNLNQMTNMFQNTSISSPATFNQQIPTTTFGQQPQFEGFGSQPLQSQPTGMGFGNAPLQSQPTGKRANLQAATPDNPFGF

SEQ ID NO: 20578 - protein, 418 aa, Candida albicans
SLVLSNKNMKIRCENLQSNSNANIAEFERLKISYDALIASQMEYKNHYQQELNSLQTAFDNYKLENTRRFEELQTSIVSNDKDIDTLLDSLTNKRKAMDNIYVNKNNKVLQLLGNLAHLAKLHGQDTKSQVEQNVSVIEQLLAKHPDLQEKILEKEKIEVDLAEIIAHSNDVLANSSFDEDTTLINSPDLENNQNFNTTHSTSGSATPNSNSHSLQSKKRKNYKRNSLILKELPPIILENVPSSLPKKPQVNNNLINIPKARSKFNTPPTTPRQFTNHNNDFEVTHQWNGNNNINNHRRNNSVDSRSDNGQHRRNNSYDSRSDHGQHRRQPSQQNNNYNNNNYNNNNNNNNNNSNNGFVKRSGSVRNVNNYNNNNGNANNNGNNHGNKFKRRSTYNNNNNNNSKRNSQLFDNNFALNA

SEQ ID NO: 20579 - protein, 102 aa, Candida albicans
IIMTDTPNSPLKSTTKSASSSTKVIDSLHSKIDELTDELTALKQSHQELTKKHSITAKKNDSFVDQLANAKHENDMLSALLKRKERRILDLEDQFNELTSSK

SEQ ID NO: 20580 - protein, 384 aa, Candida albicans
LVQNESLVLSNKNMKIRCENLQSNSNANIAEFERLKISYDALIASQMEYKNHYQQELNSLQTAFDNYKLENTRRFEELQTSIVSNDKDIDTLLDSLTNKCKAMDNIYVNKNNKVLQLLGNLAHLAKLHGQDTKSQVEQNVSVIEQLLAKHPDLQEKILEKEKIEVDLAEIIAHSNDVLANSSFDEDTTLINSPDLENNQNFNTTHSTSGSATPNSNSHSLQSKKRKNYKRNSLILKELPPIILENVPSSLPKKPQVNNNLINIPKARSKFNTPPTTPRQTTPRQFTNHNNDFEVTHQWNGNNNINNHRRNNSVDSRSDNSQHRRNNSYDSRSDHGQHRRQPSQQNNNYNNNNNNNNNNNSNNGFVKRSGSVRNVYVTTGLEDPR

SEQ ID NO: 20581 - protein, 493 aa, Candida albicans
AYFLKSTSKRLTRQQESEVENENELAKKHLLKSLRRSATPEAGTTETRSPGMSPIIDNSYQEPSNEIEESIRAQRQQVPVTSRRKIKLLKRSDNEASANLLELLGPKKTESVDTANKNPDAGNELLGLLHKKQEQNQELLPNVERSSTRKEELQNTSNELLTMLKKPTAAKESTSESRSQNLLNLLKKPESQNAPGSKGKDQASGDQLADTHLPSYTQNNLQPQLSNLNPLPSPMNFLSSPEQKPQQASQVSSANQLLGLLHKNGTERNKSITSPNELWGTSTPGSTGGPSVGEANKHSNATTGGPFRSNVLSPNLDIWTNDTKTSSLLGSQFQIPEPSRRSSQLLDLLNTNRDPVQDAQYSQSNSNNYNNGGIEIARRDSPSDKFENFEDFEDYNDGYQFNDELLDKTYRNFDIASDEEDVDYLIDPLITHNDKLLHQDNEIKPSLVDNQNDQPKKIRILKPGENIDNLFGSQGSNEPGKGLLALLNGGKAQ

SEQ ID NO: 20582 - protein, 428 aa, Candida albicans
EETDQRKFEEERPESERIYNERKAKEKEETDRLLKEIEDLKAEKEKAAELEREEAEKVAQAKLAQIEKLKQEHEAKTKLFNDKLEFENLQKQRLEEEVANLKKIRELREEKARLASEQYKDPELERVKKLIQERELEVDKLTKVIEFEKPEQTSSEGGHFLGISNDSKSGAIPVIKSKDVVVGNNENSHSKSVNTGNEAKTENESDDKKKDHHYGGAALGIAGGILAAAGAGALAAGSAGKNAVSGIASGVSNAVPSGNKDVQLPSNGSGTQGNTTTSAPGQSQSLSPLATTTEPSGSAASIPTSSNTSTISSKKNAASVTPTPVEAQRTNSLSDKFKGWGRKLSKKDKSKDVNSAAGETTAETGVIAKDDDKPVGGITALDAEKNTVVARDAKPIGGVTALDAEKNTVVARDTKPIGLHHGAEDTSQ

SEQ ID NO: 20583 - protein, 639 aa, Candida albicans
PHLGVVLVPVMITSLETVLEPPMVLVVEAVNSFQMIYWVIVFLIFNPTCCLLSAVHRQNNSSQANLFGNDFMKLDPFANPLPSINPTGATGFTGSNFGIDTFNQHTTASSSMDAFNQSLGFPSMPTLLQQQLHQQQQPSLSRVNSGWGVDTSASSILHSGSNPQTPIGGHSVLNNSISQPAPMSLWLPEAVTQSHSRVGSPFTSSVNLIGGDADPLASIQPETDVAKNNTAVSIGGVPQTRSTVNTKSSPQPEDPVLDDIHNSVVTDILNDDEPNAINNQHDQAKSVPVVNDQAALVQPTASESRQSISSETAAKVSEPEQQQEQQQEPEPEQVKAVELKPSTPQVLAPWAAAKADSKKPALTLKEIQRLEAEKLNEQKRIEAQIKSEHAAKAWANAAAAEKAVKAEKTPVALPSTWGSASNVPVTKTLAEIQREEAERAKAKQAAAKVNSPSTSFAHAIANSVPRDDGPAWTTVTSKKQASAPVVKKAATTTTIPTSVSKTTPQLLRSVSANKQTVSAVNAQAIREDFLVWARSSMTSLYPTVSKDDLLEIFITLPPNSADSSSLIAETIYSSSATMDGRRFAQEFLKRRQKVDQQIGGGDHVSWSAAIISSADKVQTVDEDGRSTSLKSKKKNGKRN

SEQ ID NO: 20584 - protein, 356 aa, Candida albicans
  UNSURE (11),(17),(18): Identity of amino acid sequences at the above locations are unknown.
HHTYYIQLTNXIIFFLXXQSKTFISQTDMSWIGIKKAINRAGTQVMLKTGHIEQTIDKEYEFQEKRYRTMEENSIKLQKNLRLYLDSLRLLTNSQINIAESLNSFYGTNNDKRSSNVSRTGSVNTGDKIQTIHEEEEEEKEEEENDNTTTTITTTNTTSNYNNLIQEYYATIKQLNDSCIANLENPYNQTVLNPIARFNSYYIEINEIIKKRHNKLLDYDAMKNKLRKLIENPTTNISPSMKTNIIESNHNQYEEKLKIYNQELTEVESKYVEINNQLLIELPKLINHRISYFDPSFESFVKIQLRFFNENYHVLNQLQLKLDAQTRQDYIEGKLEDRIDDVLRKMKKLDITSGLD

SEQ ID NO: 20585 - protein, 464 aa, Candida albicans
VKTPKPKNITKDAGWGDAEDVEERDFDKKPLDNVPSAYKPTKVNIDELRKQKSDTTSSTPKTFKSEPQEEKNDDDGQSKPLSERMKAYDQPSSSDGRLTSLPKPKIGHSVADKYKASASGNGAAPAFGAKPAFGTQSVDSRKDKLVGGLSRDFGAENGKTPAQIWAEKRGKYKTVASDEKETNSSEKVDEPEEHHAADLAKKFEEKANIAGDTPSLPTRNLPPAPPARETAIPSNEKDKEEKEEEEQAPAPSLPTRNLPPPSQRQPEPEPEPEEEEEEEEEEAPAPSLPARNLPPAPKAEAEESKKQSTTATAEYDYEKDEDNEIGFSEGDLIIDIEFVDDDWWQGKHAKTGEVGLFPATYVSLNEKAADKEEEAPAPAPAPSLPSREETQAAPALPSRSEQKPESKTATAEYDYEKDEDNEIGFSEGDLIVEIEFVDDDWWQGKHSKTGEVGLFPANYVVLNE

SEQ ID NO: 20586 - protein, 120 aa, Candida albicans
KHFHNYTTSFSHHQLLPTKTMEKIDINTNSNKIQQAYDKVVRGDPNATFVVYSVDKNATMDVTETGDGSLEDFVEHFTDGQVQFGLARVTVPGSDVSKNILLGWCPDSAPAKLRLVFTTP

SEQ ID NO: 20587 - protein, 291 aa, Candida albicans
FQILDTMSAALVNRSLTTIRTELEFLKDSDVITEGLYEKLLQSLPTKYQKDSAPWDVDRIAGGSSGPGKVQNKSAADVLADDFSKTNIFAPPPAYPPAQLPRSAAPKPVGYCIATYDYKAQQAGDLDLSKGDKLAVVEHLSEDWWKGYKSDSSPEKTGVFPSNYVKIISQLEFEADERKAAPPAPVQSPSYEQNGYSAYGPPATYPPQQLQQQPSYGGYAQYPPPSTNYYPPQQYQQPQQPQQSQQVVEQQPEQQHSLGSEHVKKFGSKLGNAAIFGAGALIGSNIVNSIF

SEQ ID NO: 20588 - protein, 278 aa, Candida albicans
IIFATSSWIKKLPSTMQRRLVQTASYLIRRNNVACRFSRYNGLPVASYSTKTVPFTADTYSQKVQRDAKFKQLESQDIEYFKSVLPENSIITDEDDLLFFNEDWMRKYRGQSQLVLKPKTTEQVASILKYCNDNKLAVVPQGGNTGLVGGSNPIFDEIIISLSAMNKIRSFDPVSGILKVDAGVILETADQYLAEHAYMFSLDLGAKRSCHVGGNVACNAGGLRLSRYGSLHGSVLSLGPVLPERYMFILYAFIGVKYNTGFELEPLVFGILKGSWGI

SEQ ID NO: 20589 - protein, 130 aa, Candida albicans
  UNSURE (51),(60),(67): Identity of amino acid sequences at the above locations are unknown.
VLTSRSFYSIGRSLRVSGEINTRLNDAEFARLEDESKPVLAALVIVNIGDXNLHLNVSVXKYSPEIXTILEPLFYEWIAKKNGSISAEHGLGFQKKNYIGYSKNEIEVKLIKEIKQHYDPNGIMNPYKYV

SEQ ID NO: 20590 - protein, 271 aa, Candida albicans
  UNSURE (44): Identity of amino acid sequences at the above locations are unknown.
RSKCSHNHQGCSSGALTFIITDAVRVFGFGDARTAGAFGIIIVXVPITEHNEKISTPVITATPLIAPLLVGTSKNIRMLADEKFDPVVDGSETSSTRDGVKKSMVIDSQELQYIFNNLTDDEKKNLPPHLKYIRQFKDYPKIEVDMKKFEDLSEVKLFVDESMSKRSILKRRKRMGGGGGGFTATMKQTMIGGGGGSSGSSSNSKRVVFTNKISINETFASDMYKRYNKAVTQYSLSDPKEINKIKNELNYYKCNEMLVHESSQNNTHFFY

SEQ ID NO: 20591 - protein, 184 aa, Candida albicans
  UNSURE (182): Identity of amino acid sequences at the above locations are unknown.
AIFDYKSYYDEDLSFDAGTIINIISVENDEWYSGEYDGKQGMFPKNFVEELKEPTTAESSGNSDQPAIPEEPNPALPLKVETDNNDGGSNNAPVETTSPKKSIEKPLGSPTETVHSALKAIESHSSKVPMPQSFSSKPVDPYSIKKQFVGASASSYVPKIQPRDDSYLVARPLHDSKAPLVXES

SEQ ID NO: 20592 - protein, 355 aa, Candida albicans
VMSSEINKLSNLVSNHLKIVDKRITGNEQFHWNRLKRTPQILKQKIKFAGGSYTVDQTFNELDEELLVIDASIKKLIKYTKVFGESMNQVLSNSVCSAESFQNLIDPYTNLKSDSQILEDAYATWSKITKYKHKVKDVFVENEIDHLVSSVEKKLLEITKIYKAVFKKIELRKTALLDYDKVYNDHESLLLKQEQSELTLKQNNQLYSLERKLDDTKIRYTRINSLLVRELPLLIRLTQEVMGYVQAHIYYVHLTFCYQVAERIKETEFIENDVNKIVTDFMLMNDPIVQEIETYILTSHQAESNNDDNKTKESYCYALHDFAGQEESDLRFSKGDKIKILVGNGTWWEGQLNGK

SEQ ID NO: 20593 - protein, 479 aa, Candida albicans
LRQKAMPLFLQLIPSAPSFSYTISLPSSFSFYFFNYYNLMSFKGFKKGVLRAPQTMRQKFNMGEITQDAVYLDAERRFKEIEMETKKLSEESKKYFNAVNGMLDEQIDFAKAVAEIYKPISGRLSDPSATVPEDNPQGIEASELYQAVVKDLKDTLKPDLELIEKRIVEPAQELLKIIQAIRKMSVKRDHKQLDLDRHKRNFSKYELKKERTVKDEEKMFSAQAEVEIAQQEYDYYNDLLKNELPVLFQMQSDFIKPLFVSFYYMQLNIFYTLYTRMEELKIPYFDLSTDIVEAYTAKKGNIEEQTDAIGITHFKVGHAKSKLEATKRRHAAMNSPPRTGASYIASTGTGGELRAYSPGGYNQPYGDSKYQPPSSPATYQSPVVAATAQSPATYQSPVATGQPPSYLPQTPASAPPPQVGSGLPTCTALYDYTAQAQGDLTFPAGAVIEIIQRTEDANGWWTGKYNGQTGVFPGNYVQL

SEQ ID NO: 20594 - protein, 69 aa, Candida albicans
YTNFGGAQKSNATQAIALYTFKGEQSGDLPFKKGDVIDILKKTDTIDDWWTGRNNGLTGIFPANYVELI

SEQ ID NO: 20595 - protein, 339 aa, Candida albicans
LPPVVKIPEPLIPLEMYEVFRDPLRNRSRIINYMKYKAAVATSSISSPNPHTARANGNNNNNSYFPDMSQPLTEANIGKLNHDIAPRKNSESSSNVFSQSAPMPLSEEEVNTKSKKKSKSYKKLTNDIHEAIDEYKLLVNELPLASKQLLFYILDLLSMVQAQSKENLMNSRNLAAIFQPSILSHPNHDMDPVEYALSQAVVEFLIKYSYKLLPTTVSASPAVKSPVAARDESDVTSTSTTPLNEESHLSKENYPHRESVTSEPQDSLVAGFQHNVTGSIPFDSDIESDIGSDLDDLNFQQLKLNDGSPVKSSPPPAPQMPAAIVVSPPSSLSVHQLDK

SEQ ID NO: 20596 - protein, 282 aa, Candida albicans
IHISQPNKSLSDSTLVVSRENFEYMDHLSPDRHQGQFQQHQQYRQQYQQRQPQQQLIEDEQAHKATRLKFWRRPKVGTTQVILSNEYNNNGNGHNNGARIPNSFSTQALRIPAHNSGSSFNNNGANNNNQQNKFSKSKSSNVLDSLLSGDSSQVPLFNSTLQQRAEYEKSQVPIIITRCLAEVEKRGLDFEGIYRISGGNSAIVSIENAFSSLSNDPDEKQLNRVDETLDVDIHAVTSALKRYLRKLPDPVIPFDLYDDFIKVSTKASHSKEVRNGRIAEEC

SEQ ID NO: 20597 - protein, 227 aa, Candida albicans
DLTFPYWVEFVFNQFSMAVVDNVIVEYLFTIEFFYQGEEKDNSWAEEMFKNVFQIGQEFLTYISNTLDAYGILFIIRLVQKSQAKLHEVHIPVLDDYLNSLLLILWPHFTKIVDANCEAMKRTMLKGKKATGLAPISITQQFAQFFSALLELSVNEAEPLISSIIRLRNEYESYLMRSTSLSGTEKEIFLYNNYFLVLSVLKNQTSNSFLEEQILHFQTLTDAYTKH

SEQ ID NO: 20598 - protein, 300 aa, Candida albicans
WYSSAKVYLQPMMSTLMLEKLIKKFPNLKGLYISGNNYCNADIENMNLNMPLTILDLSYNRLEHMPILPLVSALNLSHNYLSLRIIKGTFPNLKSLDLRANQIKDWTEIDKISIHLPDLKELRINHNPLFQELSVDDMTMQLIGRIKCSPEHLWKLNGSFLTNEEIENSELYFISKVEQGKYHIDNEQQWSYLLSKYNKLVESRVSYTYTLKDWMPLTIVLPDSKEISKKFTKNTSILQFKGLLSLWMNDLSILKFSAYYYTNENSTFAEKHELTNYLSTLDSYSLLYDQRIYISIEASI

SEQ ID NO: 20599 - protein, 324 aa, Candida albicans
FNQLCFEGVIYSLYSNMVVGESRAELLNWLNSTLGLNYTKIEQCGSGAAFCQLMDTIVGDVPLSKVKFNAKTEYEFRHNYKILQHVFVKNSITKTIDVEKLIRCKLQDNLELLQWIKRYASSNNVPMKTTVARQPPKQTTKPTTSSPGSSPINAGPSAAPLISKPRERKSNTPIGSRKTSSNGPINLTPTAVRSTNIAASKNNNRSGNGTIVNNGHVGAVSASEPEAVDAAAVGAAAVGAAAVGAAAAAAAPIDSGATSSIPEDFAIYSQHVESERDFYFNKFRAIEILVQHAKEMEGLSGDVLQFVNEIEKIMYEEYVEDDEF

SEQ ID NO: 20600 - protein, 319 aa, Candida albicans
QGFQITHSVGGGTGSGMGTLLISPIREEFPDRMMATFSVVPSPKVSDTVIEPYNATLSVHQLVENSDETFCIDNEALYNICQNTLKLPQPSYAELNNLVSSVMSGVTTSLRYPGQLNSDLRKLAVNLVPFPRLHFFMVGYAPLTSMGSKSFRSVTVPELTQQMFDAKNMMAASDPRNGRYLTVAAFFRGKVSVKEVDDEMHKIQTRNSSYFVDWIPNNVQTAVCSVPPKDLDMSATFIGNSTSIQELFKRVGDQFSAMFRRKAFLHWYTSEGMDEMEFTEAESNMNDLVSEYQQYQEASIDEEELEYADEIPLEDAAME

SEQ ID NO: 20601 - protein, 367 aa, Candida albicans
  UNSURE (52),(365): Identity of amino acid sequences at the above locations are unknown.
IIIYTRYKHVLLMSHKTPTRARSCYANSSTTSMNSTPSRNSFRPPSRLSLIXRSSSPIQPPRSRPSSAMSISRPSTPSMKSQEPYTGAITVSIRPNPNTIDNKNWSIDEFNNSIINTTDGTRFVFDNVFPMDRQLSNIQVYNKSCYNVVNKFLEEGYNGTIFAYGMTGSGKTFSMKGCENDPGFVELAINDIFQKINDNTTTKKYKMDISYLEIYNEKIIDLLSGSASSPTTSQSNQDLKIRDDVDFGTKVVGLTSANISSKPQLLQLIKYGDTNRKTSATDFNARSSRSHSILQIRLQVIDLLTETELKSTLSLCDLAGLERAATSLESRKEGSFINKSLLALSNVINKLSSSTLEHIPYRDSXLT

SEQ ID NO: 20602 - protein, 715 aa, Candida albicans
RCNKPQTRDQLTRSFTLLFLSLLFFHCFCSIKFFLSFIIIIYTRYKHVLLMSHKTPTRARSCYANSSTTTMNSTPSRNSFRPPSRLSLIPRSSSPIQPPRSRPSSAMSISRPSTPSMKSQEPYTGAITVSIRPNPNTIDNKNWSIDEFDNSIINTTDGTRFVFDNVFPMDRQLSNIQVYNKSCYNVVNKFLEEGYNGTIFAYGMTGSGKTFSMKGCENDPGFVELAINDIFQKINDNTTTKKYKMDISYLEIYNEKIIDLLSGSPSSQTTSQSNQDLKIRDDVDFGTKVVGLTSANISSKPQLLQLIKYGDTNRKTSATDFNARSSRSHSILQIRLQVIDLLTETELKSTLSLCDLAGLERAATSLERRKEGSFINKSLLALSNVINKLSSSALEHIPYRDSKLTRLLQPALSGSSLVLILCTIHMGGNQQNSQQCVAETYKTLRFAARAKDIVINVEKNMSHKLDGGDSSKMIQELNEIISKQRQEIIKLQSNTGVSSKEFENSRIVQLESENRVLIEKLDHLTRLTDLQKTETAIIKNDILNDILSSGLDNLQILMTNIEDFYKKMTYEANEYKSYICRLETQLRLESINSTQQQQSSSPTSSIPMTNTTNDSSELMDALKEQEEEILMLKEQLKDKDQIIKSLSQTTRLRRLVGNNSNSIANSHNTYNTLDNDFKRHTTIVNFDKENYEPELRDFKLSPKKPKSNCDILESF

SEQ ID NO: 20603 - protein, 328 aa, Candida albicans
YYFSIVLLFFLFYFQVMAISRSLITETSNRFIPSSSSTLVYKTRHKNELQLSYQSHENLDNNIPHANLSIRDDSLFTHSTSSISSNTHFQSSSSSIGSSSAIKRVTLGSTKPSDLHQKIVAEALNFVLSSKVLKFDNKSRSKKIQNRIDAKLVESLTIAEREVSVDAGKSRSTSSIKTIIATDILQAPGLRNDYYSNLVSWSFKTNRVAVGLGSKIYLWGVDNNVTQINHSNEDLVTAVSCSKEYWILVATAGGKIILMDQQSNSVVSEYTNNEGKCIFCFAWFDKSNMFIAGDDFGEVYIFKIHKLFNVQIELVRVFKCHQQQICGM

SEQ ID NO: 20604 - protein, 202 aa, Candida albicans
NTGLALNGKNDEIAVGANDNCCTIWSIKDFSAPVLKFVLPHNAAIKALCYCPWTVSLLATGGGSKDRKIRFWHTSSGTLLSEYYTDGQITSLIWSRFRKEIVATFGFGGTSKSNLLCVYTYPQMQPILEVNAACNLRILSATLLPDYCSVCVATNDSTIRIYQLWEGSLEILPSATQRIMGAFGSDIIELLEGISKTGDVIR

SEQ ID NO: 20605 - protein, 350 aa, Candida albicans
STLLSSRGGDFEYSSTISTQSSSGSSSIPNSQLFRTSFLTKSGTLTPSAAAARANKIPNAPERVLDAPGLIDDFYLNLLAWSLTNLLAIGLEDAVYVWNASTGSVGLLCELADKTLVTSLRWSQDGSYISIGKDDGLIEIWDIESNTKLRTLNCDNHLTRIALQSWNQHVLTSGSRMGHIYFSDVRVANHLVNKNQEAHSAEVCGIEYRPVGNGTSSTTSINDSLQFATGGNDNLVCIWDARNVTTPVFSKSNHKAAVKALSWCPYQSSLLATGGGSTDKTINFWNTTTGAKVNTIETGSQISSLNWGYAHGTGLEIVATHGFPSNIFHYLIYQRYQKLVRILMLMIQQY

SEQ ID NO: 20606 - protein, 164 aa, Candida albicans
RPQLPPSLRPPINSRSKTAVLPSLSKSTSSLATTHSLTQSLSNPFILRRANSLISQGGSSSLSDLHQQQQSSTTSSDRFIPSRYNSVTGKLDTTNEVPLPSAAPEIHIKAQTSKIYQHHVAEACGLEMNSRILLYQPLPPERKKPVNLVRQVFNRRWKDNVRGS

SEQ ID NO: 20607 - protein, 413 aa, Candida albicans
SRVEHLTKNMDKRDSNRPSKDNAIRNPFVLFETPRSPSRSTRSLNPPKLNEMGAIQSSPPRRRNNNTIFSDRYIPNRTGVDLQAAFSLTNEEILPDLRNTRNADNEIEIRREEEANRTFSTVLKAELFGDNVPMATANLSSATANSNLANNRSKTGRTNTGIVNGASVSGAATSTSSLSTTPPRSSNSGQNFPGSTGSSLPGNNNAIGNNDSHNIISANANNNISSDIDDITSTPRRKTNLFTYQSPQKSKPISRDLQQELYSLSPVRQDSQKLLLSPQKKPRTISKVPYRVLDAPELSDDFYLNLVDWGQQDVLAVGLGDSVYLWDGATQSVDRLCNLTNKDKVTSLNWIGTGTHLAIGTSKGLVEIWDATRIKCIRTMTGHSLRVSSLAWNEHILTSGSRDRTILNSRCEN

SEQ ID NO: 20608 - protein, 195 aa, Candida albicans
ELKITLLIKFDNHKQEVCGLKWNVEENKLASGGNDNNLFVWDGLNPKPLHQFTDHTAAVKAIAWSPHQRGILASGGGTADKTIKTWNTLTGNLVHDVNTGSQVCNLIWSKNSNELVSTHGYSRNQIIVWKYPSMQQIAQLTGHTYRVLYLSLSPDGETIVTGAGDETLRFWNVFEKNRHNESPASVLLGAFLQLR

SEQ ID NO: 20609 - protein, 181 aa, Candida albicans
LRPKKTNPRGIPKAPFIEKVETVIKNPETEFDNTMSMFQQRLQQYKYMEASKKQQLADLQTKIPDIEKNLDVIKHIKQRKEEGDDKMVTNYELNDTLYSKATVDVQNLNSVYLWLGAEVMLEYNLEDATELLNERLKKNQEQLQIVKEDLEFLKENITTMEVNTARLYNWDVERRKKAKAN

SEQ ID NO: 20610 - protein, 278 aa, Candida albicans
WANTSIMSEDIPPKETTQEENNNHEENQNVAEEVATSQQPAPAPAPTEEEEPETEKVEPIEEDKEELPHQETNVPEVGNDLVQEDPHTSFLQPPSDKQQFATPSKDLPALKDIETITTPKTFDVAKDDDIDDDATKGLADIVASSPIKHNILAELQQHEESLNEDTLRIISGYLSLDESSIKSIGDANVLHALVSKSVEFQNISSENEFLKLEMEPNAQSISKQLPELQPKYSNADNLFQVFNQNRKDKLEYENIRQTEKIQELEPANDYDKPDNSMR

SEQ ID NO: 20611 - protein, 472 aa, Candida albicans
  UNSURE (360): Identity of amino acid sequences at the above locations are unknown.
HQSIRKRQSAQSAPPPPATKFSSSIPQKPTLLLKKLATSPTKNYTDHINQLRSGPNSPKKYQDDENIRSLKYEIKRLKQEQNLKLENLQHKIDYLTNERDELQNQLTSMSFENDKLTKKNRSLSHENNHLTLENSKLKTKEYSNEELQLENNKLQRVNSTLRNERDELVKDFNITRDKLKKYYDLYLHCQKAHAKEMKKRIEVDGDKPISDKPMADNSTNQELVDVLKKLSEMMIEQKKILEPSAAVEKDTTSEDKTPPIPNTANSSDTPRMVSDFLEDFIKRVFEEMLSNNKNTLSPKQAINSQTYSQPNNFSNNTVPPSQSAAYNPSNSQPAPPPQPATNFYSSSTPNTNGYNQSLQXDERPETFELPHVAKDHWLQRPTSERSTQSTKYMKMDPEDIRKLVLVITDQLKKEQKSEKPSNVVEMETPVEKCQCCHGNPRNVTDTNNNQKLCQSCLNKGDFTMSEFMGRSN

SEQ ID NO: 20612 - protein, 864 aa, Candida albicans
PVKFNKCEDMAELTHLNEPSVVYNLYLRYLDDLIYTYSGLFLVAINPYKLLPIYNQSILMKYHQYNNVTTNKNDYKSKNASNSNNNNKGQSPPHIFAVAESTFRNLLSNKKDQSILVTGESGAGKTENTKKIIQYLSSITSGSHTNKVDHDNSIDTKILQANPILESFGNAKTIKNNNSSRFGKFIQIYFSNTGEISGANINYYLLEKSRVISQSNQERNYHIFYQFLKGYENLPSLGLNKDMSTYNYLSGGKLTINNVDDFKEFNLLVEAFKIMGFTTNEMNFIYQVLAIILHLGNITFTSWKSEQANFTNDSPIDRICELLAVDKDLFVQNLLRPKVKAGREFITKSKKPNEVKFAIDAFAKYLYEKLFQFIITKINEKLDQSHNGDDNTANNNNDNNFFIGVLDIAGFEIFDINLFEQLCINYTNEKLQQFFNHHSFILEQSEYLRENINWEFIDFGQDLQPTIDLIETKQPMGILKLLDEECLMPKSSDASFMEKLSKNFSNTHKKFSENKFKNGFIIHHYAGKVEYNVENWLQKNTDPISESILNLLPDSQNELIADMFINDPHINRPQTNGGGNSKLKTASQKHKDQLKTLMDQLESTEPHFVRCILPNLEKRANKFDKNLVLGQLRCNGVLEGIRITRAGYPNRMMFDEFIQRYSIICDNELSSPQNKTNCEIILKFVKLNPEDFKVGLTKIFFKNGILGKLEIIRDLALKNIFTDLQKVIRGNLTRLVLKQKIKEIQSAQIISRTMVTLDEIKSNSPWMRLFFHVKPLLEDSAKVLDSKKLQENLQTLTVKLKDSEKLTKGLETDNEKLREQMNNLQDEMINITSIAKEKDDKLSQLRLTENKSKHLHHGAGKSRA

SEQ ID NO: 20613 - protein, 722 aa, Candida albicans
EYQPPNPQFMEEFTHMKLKVNEQTASLRKEKFENKKLLEELQMLKERIMNGSLTSMDLTPKRRSLAIGDKSMITNTVDSFNKEIENLKFQLQQEQGNFHRAENYAIELQKKLNKLLTTRGLNTNTDYEKKYNDSQKRITQLETKIGRLLANSGGDYEDHHLDDNDDDWESRSSNGGSGGGSTSSSARNSLVKSESITAFHNMRGVSQDYIQIYQDITKTLKSTREELNGSKTEILRLKALLRESEDELYQVKQENYKTSVHDYEQDLAQLKVKHETLLSRNKDINESLEIYKKRSDEYYKKLELAESAIAISKRHEEQATKEMKESRSQLLLVREELRTTQILIKDFRIKVENLEATIEEKNHQLDANKEEIKQIQDKLNYHLKNFENKELNEKLKEEIKNLNRDLDFKTDIETKLIKENKKLQLDYEDVLLVKNNLQNEVEELILQEEKLQNKIDELTNNNRQLENEKLINERKIVNCTKQISGLKELVDEISIERDKLLKDKETLQNDLQTMTNKFDATTTELKQAHGELDFLKKHLENQREDSEAIKTELNQLKMSTSFDIRDQQKLRNELLVTNEENFSLVKTNKELNLKVSDLEEKLYSNEQLRYWESKVDTLSKALDGALNEKHEADKTIKNLQRSIKQLEIRVENESQLSKRYNDDNFDYQNKINHYKSTIDIIHNENIEKDLQLKSIQRENIEMKESMLMLQKEVLELRERLLV

SEQ ID NO: 20614 - protein, 627 aa, Candida albicans
FVSYLFQQMTTPSYTKNLNMNTKSSKEQTRSKRPLSEISPNLRRDPLKKRRNSLGFEMASIPLNSIKSFPSRIPPPTASKSATIASSSSSSSSSSMLSLSSIPQGILSIQERLRRKASVNDNNGQSSSSFAARPQSTVSRSNELQEEYYSLNELYKQQASLYEKLEVELGKLKEIYKNYYYKIDLINDLVHQKQSEFEILEHDIINDVEQEEKLTYSKLHENKIKLDGQFKELEFEMLNQLEDAKQFDFKELLTKIESLKTEKMTVLSEYEKVMSEVNAKLNADREQFSKDLEDKLHPLNKNKQLINDQLINKKDELTKLETNYNELKDQLAERNDSIDSIKHEIANIEQEMNNYQATRKNLELKLSEAELELHEALAKDKQEQREYDNVRSEYSVLHSKIAKHDEHRRILENSIMKIQGKFRVYAIGEDLDTYNKCFAKDTPSSFIIDEFQCLVQSTLKGHNVAIINNYLRGSQIVIDSYKNIQRQQKYIYQCISIKNGDKNTDICDLLNSNAPVDSLFQHQQMVIDDFDQFKQIVKKIDATLSQEIAIHIISTDKSKLMIIDCSRIDPDQQDKILEKFKSNSSLGFLEKLLTWIYHNCSTLFLYEPKTSQSNSLLKFINSIDSPI

SEQ ID NO: 20615 - protein, 164 aa, Candida albicans
YDVPWRGVCENKQEMVKLQEEVQNYKNQQELHLKTIKLLEESNNNYREEIESVKRELSNEKRNATITTNHKDTHINNLKSELEKANYRIKDLEQEREINRLQQLNLAFERSNISSSNSRNSFYKPSPNKFAPSDISTGVKRLSIGGEENNHFGGGGGASPNFHN

SEQ ID NO: 20616 - protein, 215 aa, Candida albicans
HITSMDKFDSSLDLIRRLDPRSITTNLSNICALISEDEELVADLLSSVDTPLTTSTCLKSGKDYLCCDYNRDGDSYRSPWTNVYYPELSLQDVNDAPYPSSILRDLEIKANDSFDIYRDLYYEGGISSVYLWDTSEEDEDVDSTTALQNGFAGVVLFKKETEDKSGNWDNIHVFEVVPQSKNKYVYKLTTSVVLNLENKKQVDGNLGLAGNLTRQ

SEQ ID NO: 20617 - protein, 646 aa, Candida albicans
KQIPKGSIAPIPVLQLRNPTPTMIEIQSFADFLRIAPVICVSLDGVNFSVEQFKILLSAMSAKKQLEKLSLRNTPIDQKGWSLLCWFLSRNTVLNRLDITQCPSLSVNTLKKKKKKTDSKFDETLVRMVSNKDNRSDVDWELFVATLVARGGIEELILTGCCITDIEIFEKLISLAVLKKTSRLGLAFNQLTSRHMKIIVDEWLFKDFARGIYFGYNDFLSVHMLKILVDYSKRPDFDQILLKSTLSFVSLNSTNVSLGDIFKESFERVLMKLPNLKYVDFSNNQRLFGTFGKSDNEEADANEVASVNYFISKLPLFPKLVRLHLENENFSKSSVLQIAEILPFCKSLGYFSILGSKLDFTCGSALVNAVKNSQSLINVDADSDNFPDIFKERMGLYTMRNMERLLYSAKKADVKTPLLSEDSAGNVSMTEQLHEILRLKSQQKLDLQLPEITKFIERAKSISHGLRQTINELLRMQLKNRLDLDGKETLIRLIFIDSSIEKGLMLIDPSLVDDNNKNAGYLTSMIGTREGNEETQQFEQSDHLDPQPAASVLANKSPSVMSRSDSRTSLNNLNKEEGSVLKLAKLRDFHSPNSPYPESTGEELRNKLMSVELADLDKVIDFLSDLKQKGSFVGKSFPVSRESRCT

SEQ ID NO: 20618 - protein, 694 aa, Candida albicans
TAYLPFRLLRQRNVCVHELGWKYLCEFLATNKTVKKLDISQQRIKPDTPDTSIRGNMNWDLFIRSLILRGGIEELVINGCKLSDAIFEKLINQAVKKSTYRLGIAGIDLNVKKSEMVTSWLTDGNSQCVGVDIAFNDLSKGQLRPFINAFNTGKVNNLVFFSLNSTNLLNIEETSDLIKSLINVKTLRFLDLSSIPNIFPKIITHLDKYLPRYPNLRRIHFDLNELTAQAIGSLAGCLLKMPQLVHVSLLGNKNLSTTSAATLYGAVKQSKTLFALDLDYDLIPDQLSQRIAFYLMRNLEYTLKPSHGGNIESNPEKPEDLMYDGSLLMETAEKLLVEIEKGKKEDIKMQRIISDSVLERTRSIRKDIHKTIDTLFEQRNLGKLSFEGKENLVRFCLLDSSLEKLVVMVEEHANGLLLTPTTSTDDFRSRAMSPSVTVDTIHESANELITAGPILSPHVNRKAEQSSYFPVFANNDNLTPHQVVVESNDEGRDVPIDKMTGRPVLIRSISQTSVHAKEQEIEEGELHKFGFFIQQKERQKQQQQQQQQNSHHQHQPAQLIQQENQLPLPQQGKYEDLPILNTLPSGPELRDAIMAAKGVANVTELIDRINNHRVKIDAPSTKHHHELNKPNSDKVVEDEVEVSDNASIDSTNGDDLHQLGDGKHNGNGTVDPMVSEVYDKLLNDAERVRLNRDI

SEQ ID NO: 20619 - protein, 365 aa, Candida albicans
IFFILHFLKYLRNKARFSFVYIAMSMNTPAVVMDNGTGLTKLGFAGNDSPSFVFPTAIATSSASSKAGKGPRGSSLASKRGLEDLDFYIGDEALEAASGSQYGLHYPIKHGQIEDWDQMERFWESSIFKYLRCEPEDHYLLLTEPPLNPPENRESTAEIMLESFNCAGLYIAVQAVLALAASWTSPKVQDRSLSGTVIDSGDGVTHVIPVAEGYVIGAAIKNIPLAGRDITLFIQQLLRDRGEADTSLQTAEKIKQEFCYVCPDIVQEFSRFDQYPQEKFAQYMVEYTDKNKRNTVDVGYERFLAPEIFFNPEICSSDFLTPLPTVVDQVIQASPIDVRKKLYKNIVLSGGSTMFVFTSRDGRST

SEQ ID NO: 20620 - protein, 202 aa, Candida albicans
AIFFFCLLLLIGPDMAEDMDSADTQVGDVDSSMNASLPEPSKESSRETTPESVPTNDQSDRPKPKKRLTLQERLAQAAKGKKKPSSTTPTSLSRTTSNEDQKPDLDLQMEIERLKLENSALTKKLNHKSNFDKERNDLIAKLASKDETIEQLRKEGEALSLKELKLNESIKKLKLANQDLEENIRDYSVKSEESSMKLEELT

SEQ ID NO: 20621 - protein, 187 aa, Candida albicans
PMTPPSNISTMPATSRIKVDDLSNTISKRLDLDPIMVFLEHKVAALHDLAIKSSQNAALFHEFGRIWESVTKLMNSQEEKLESILNDDSNSKLVTRILNSTLEQLKSTLSALKSNPVTSGSPRDEVLISLITSEYNAIEQAVKLVSPDLRTIGELNSSGGLPPSSSKPTSQVYPVSTSDTKLTTKME

SEQ ID NO: 20622 - protein, 212 aa, Candida albicans
LLLLYICYYTDNVVSYPHFPMSNTETESKKTEGGDTSSHVFGNALQTWVEIDLPSLQKKLDEQGIELKEDQKASLLSRKNLASKTKEFKKLEDSEKLNQFKSLLKLYQNEIDNLTNKNKMVENYFFGIYRSLAEAPDPRPLLEMSLDSVIESKETVSFRKEVDMLTDELAKRADYDNLKQRLLQNEQNAPELLSLKLNAKEDEFKFIIDDKE

SEQ ID NO: 20623 - protein, 136 aa, Candida albicans
PETQRHRNKIVFELEKRNEDLRRELSKSQNDIEIKLIKEDYSKRVSELEGENVLLVANLNQTRKKLQDSDKEHALKTDSLNRDISSMELEIKNLKAQLDKASDYEEIKSELQLLIQIEFGHGDDDYYDDETGNANA

SEQ ID NO: 20624 - protein, 338 aa, Candida albicans
IPDSYIMSTNEVVDKSTLEQLKVNLETAKPVKEEKPAASAETKKSSNDDDLDDLDDLLDDFADDVLSKPPGASVSQRDDQSVKHESDKAKDPTDPLGNDFQKSINELISDLKIEDPDTQKQFEDLVKQFETNHRESVEAEEKKPANFEYVMKETMERLKKLGDDIDVKFKNDPLGSNPEDLLTQLLSGMGDAGDGDFDMSKLLVDMLEQLSSKEVLYEPIKDLNTKFPEYLQQNKDKLDEAKYKNYTQQYEITNDIVRIFELESYSEENKRQREQVNSLLESLQELGQPPSELVGETGDFLPGFGGGAGKGGDNPFGFDEKDLPPEFGKDLQEGCKQQ

SEQ ID NO: 20625 - protein, 175 aa, Candida albicans
  UNSURE (8): Identity of amino acid sequences at the above locations are unknown.
SVGTFQGXVEEHRSVEYYDDSMNSSGLPFNFLAPSQVRGSTFIMDSNISTINNIKVICRFRPENEKELQKGKLIVEFPNTQTVTLYGKDYTTHYSFDRVFSPEASQLDIYQFSIAETVDDLINGYNGTVLAYGQTGSGKSYTMLGGPQLLDPNSKGIIPRISHEIFERISANEAV

SEQ ID NO: 20626 - protein, 256 aa, Candida albicans
SQSLSSLTKGTSTSSTNSLIQDSIAQYAQENIISIDNIIISKYNKDENSSKYIDYVNNKLFNVDWQNQKIIDVESYHDNNNKRGSNYDELIQKLSQYGDDYYPSNFAFTVIPESEDQLRVIIIGQRANHDNFYTGQWKSNYLITEQGIKGNIDLDIHYFEDGNVRLKFNESINSSNNNNNSSTLQSGNLINNASRIVNFINEQENATMVKIIEQFNNLNQKSFKNLRRLLPVTRSKINWGSAIGNYRLGSDVINKK

SEQ ID NO: 20627 - protein, 146 aa, Candida albicans
LVVSFFLFFSVTVADESLTAFNDLKLGRKYKFVIFTLNDEKTQIVVEQTSTEQEYDAFLEKLPENECRYAVYDFEYDIGGGEGKRSKIVFFTWSPDTAPVRAKMVYASSKDSLRRALNGVAADVQRTDFSEVAYDAVHEKVSTCTH

SEQ ID NO: 20628 - protein, 982 aa, Candida albicans
NHLLLLHGLISIKLVSDALALIDSFLGYLVSEKCDSDILFEKISKLAIVINEIANQGDRQRLGSNEHSVMLREAVAYSLTATRYHATYKQLFPRYIVEKSIGELNCILCDLIAECKLNENSTNLRVLEVETKVPKKSVNEDFGVRPLRMANKLKVNQSQQEPTQKSNSETRALQYEEQSPFIEETRDKPLKSKANSAFTTLRAQREKAKEEKSPTNATHGTSFSKGATVAATVGGALIPAAAQVGDPRTKKSTHNVAFNDNPISISPRYQNYDSDENEDDLNDDVPTNDNFNAHSNKETKFDRKPYGTETQTNNLTSGALSTNTTPTKVKISRSINEDSDELVSATNNSNFHDNSGYQQSRNLDSSNNFVTQNSGNLNSYKPNLDNSPVRKTSLDSSEDKYALPMRDTDQSFDNDQDDSFETAYTFGKNLDNVHDSNTRKEDVATRGLGTNNEVVPQKENFETEGKKKGSIALLASKYENNVSDQSTSRNYSPIKNKSDKSSQGVQELARRITSPEASPESQKSISQASKISPSKKGVLDKVKQFESPQREDVPSSPSPRKSPGQDKVPFKSMRTSLELSKPFKNEEDPGQLSAPFSAIHLKNEVGEETSKKEIENSAAAETSTSSDTSTSSSAPVKSKGLFQSLKDRFTGETKKEEEEEKVQQQQQQEEEESAKHIESSQSDATISDNEKQNDTQNENLMNTVETSPPKDVNDEIISKPVQVQYPEQKTTHSGEQEVEKSKDLPIERRDVVTEPSTGIKHEPAESNKTEPKLQQQKSLLQKSKQQKPVTPESEESYSEEETEEEIRARQRQEYRKSMAAATFNVDLFDIDDPDNTLTQVLLYLEHQTVQVINTIQSLLAAIKKPNATRGELREKTKAITIVISQMTEATNTSMNQTRNAQLKEHGSWVVRSLEDCYHRMNILCKPGEKPDTSFADKNFKQRLAGISFDIAKCTKELVKTVEEASLKEDIAYLDARISQNLE

SEQ ID NO: 20629 - protein, 504 aa, Candida albicans
TIHIMSEKDLVQHYKVLKQFLAISDDQQSRSKSNSSRAQRAREKLLKLSSAQFKELSTDVYDELRRRIDESRSEPDYLLPKSSFHPKRNQARQKLASLPQTRFKDLVADISYEIERRDLHVERQLQHSHTTSMSSNGSQFQHERKSSLASSHHRNDSANGYHSRLASHHLNDFAATKEVDEEKESDSRDDLNNTSSKNITMPNAEASNQSIGIQPSQVVPTKANLDWSSDDEGDDEQEEEEEEKGKVKNISDPKHTQAEQHQNQHQHSNSLSNNKDINTKSDRGLTHDEKDNELAKLETLVNDLKNKLQASESERSKLKGKLESLQEDYNFSVSQNKSLSNELETLGKEKERWITKHDNLTKSMSNSDENLKEIERLKSINAALRLENQSLKNTSSSPRSVGSPPSAINAITTNSGNSGNSAKLSQKSVDEFLEKLETIQLSPGSTSNNPSTLELKNQIKLWQRRYEDSRSNAIARDIKKASLPKMELKPFVASARFNFYKVGQ

SEQ ID NO: 20630 - protein, 61 aa, Candida albicans
VMSFQDLIPVVNKLQDIVTTTQVSDIDLPILAVVGSQSCGKSSVLENIVGKDFLPRGTGIV

SEQ ID NO: 20631 - protein, 165 aa, Candida albicans
PTHNLSIHDIRTAIRNSTGPRPSLFVPELAFDILVKPQIKLLEAPAHRCVELVYEELMKIVHSVCTADIGTEMSRYPRLQNKLIEVVSDLLRERLGPTIKYVESLIEINKAYINTNHPNFVGAAKAMSIVVAEREKQKELELSSRLRLASERILILMKKSIIVIM

SEQ ID NO: 20632 - protein, 268 aa, Candida albicans
ENQDGNNSEEVVEDLEADIKSVDDVVPKSNRRRATSTRTYSVRSESTSGHYHQHQHHQGHLHQQSSSSYLNYFLGKDPVVHQQHLQTQAQLNPTPFKFPPPQEASSLQFNTTFINSNTSTTTPIANNNHNHHNGGMMLTFENNSNLPDEFGNKLALSDSTVSSFESDELIHELSEREQMECELIRRLIISYFSIVRETIQDQVPKAIMCLLVNHIKQEIQNRLVVKLYNENMFDELLQEDETIQAEREKCIELLKTYREASDIISEVF

SEQ ID NO: 20633 - protein, 254 aa, Candida albicans
ELLFKNKGISSYPINLKIYSRNVLNFTLVDLTGLTEIPIGDQPTDIEKQTRSLILEYISKQNCIILAVSPANVDLVNSESLKLGRQVDRTGKRTIGILTKLDLMDQGTNALDILKGNVYPLKLGFIGIVNRSQQDISEHKSLDESLFDEQQFFANHPAYKTMAKRCGTKYLAQTLNKILMNHIRERLRDIKAKLNTLIGQTEHELASYGDGFGFGDSKESRGAMVLTLMTKFANSFVGSIEGTSVNETAARDIH

SEQ ID NO: 20634 - protein, 317 aa, Candida albicans
CLINFKFWWVMPPMIQKLKNLGIIESICEKGLLSSRKNIKEWSVESILLMIEISNDPNSIVEDILPYLTNRLPKLVTGCVSCLASIIENFGCKIISPKPIVPCLSKLFAHADKNVRNETTKLTIELYRWMGDALINALFSDLKPVQQKDLTAAFEKEKGTSPQQKRYTKKQREEIERREQEAAAAAAAAAATTAGNGGGNGDDVDDVEMSDVNGVTDDNEYDPLEFVDPVEVLNKFPSDFDSRISSSKWKDRKEVLEEIIPILEKSPKLITTDDYLPVLRIWAKCMKDANIQVVQLAANCIEFGFHYTEPGRIRDCN

SEQ ID NO: 20635 - protein, 388 aa, Candida albicans
KNQLKCEILDAFLARSKKKIINILSKLVAYLHHSSKTPYSMPEQLQKLVIDNGSYNIKAGFNTGDDDGNDTSTPIKVTNAISKTKDGIIHVGNQYLSHTNNFSGIQFRRPFEQNNLTSWETEKPIWDYTLDNLLLQTNDQSQSTSSSSSSSLQKHKRGKVIDPDDIHLILTEQPYQLPQLSTNTDQIIFEEYGFNKYYRCIAPSLVPFSVDTNQINDDFVLVIDSGFNSTWIVPMIYQQIHWPAVKKLPIGGNLLNGLLREMILFRHYDISEDPILINTIKESTCFISLSNYQQDLQHKHDLMCEFVLPDFKLTITGFVKNENSMSLQKLPNDTQVLKLYDERFTVPETYFHPEIIFDNNRTTASSSLLNNAPFKNLTDLIVESIMAC

SEQ ID NO: 20636 - protein, 110 aa, Candida albicans
RMGIEQDNTVFRVFDPAAKQEEERALHEAKLAKMEAEMKLVFQQKVSEKEKKLQRSEADLFARHKEMKDKLTKQIKLLEEKKAQLEKQKLLPQDPPAQPAPQKSRKGFLR

SEQ ID NO: 20637 - protein, 410 aa, Candida albicans
LDSLYQPKHLLEIFTQWAREEADDKFVSDAYVKLGNDFRAAIRAFSNNGIDISDIGNVPQALRIILEAALSEAPSQENLDRFLPSIRNIIVTLLQTLKTKQAKAKAISQEKSTKEELPTENQRPSSLGVEGQQQQQQQQQQQQQRTGDNDSSVERSDALSQLQKGDVLQRRASKRFSAYQYAKLTNFNNPTTSVPKIKPMESPEVRHSKIMETEEPNVTPNKGVESVQEDGNTEEYVLLRINAKTKKAKVSLPVTFASLRLLFVEKFAYSPGAGNFPDIYIQDPRSGVLYELEEHLLPDVKSGTLLCLNETDDQNKSINELNLRLDDLTKKIDTMGSTIIAQVKDSVASVEIPVPTVAASASAVTAKSGNANEANKIGRKDITNLERDFRAIKQLHHSSSTSPRRGRIQV

SEQ ID NO: 20638 - protein, 243 aa, Candida albicans
FWSILKIFNGVYMDSCNSKLSDDSDLLITKVDDLQDIMEEMRKDLAQRGFRVSDKQLTHILKDINLAKKSLHDMTLYISKERPVWKKIWEAELDKVCEEQQFLNLQDDLIQDLQDDIKKIEETYNLIEQCSIEQIKGASSKRNKIVANLYIPEPGESLHDLKDAVLNDIVGLTPNHESRLEAIERAEKLREKERDMMKLTKFQEELGDFVEDKKLKRSGGIEEIEKQRQLRDIENLKSSFGGI

SEQ ID NO: 20639 - protein, 284 aa, Candida albicans
ELYQQRRRTPEPLSEISSKQTPDTKPVSLSNATSNTGKSSSAGKHHMSFNPFSHHKKQENQTPTAPPIPQNVPPVPPSGPPHASASNSVKDAPPIAPQIAPPPPSVPSVVPPAPPAPPAIPNTIPPTLPTSESTQNNASSVSTDIPSNDPPSPPPLPSSSAPPPPRNKKAAAPPPPPTQTTGSEYKSSSSTSRVSSSNFNDLDLRQNAGTNLRKISALAYTINPRNASNGDSKPEKLVIDDKRFKFVNANALPNPRRFGERGEKEKLYPSGRGSSVPLDLSLYA

SEQ ID NO: 20640 - protein, 98 aa, Candida albicans
FETLEIAMAAPPPPPPPPPPPPSGLGNLPPGPPPSMPPGRDALLGDIRKGARLKKATTVDKSKPMIDSKVSVSAAPPQALANSSGATNSLPSAPAVPQ

SEQ ID NO: 20641 - protein, 649 aa, Candida albicans
VSRRFTVRTSTKCCYYTTVGRKKKKLTTNNQQSTVREKEREKKFINSYLTTSNILITYTIISFVSPFVFCYIMSLTSKELNYLIWRYLQESGYDLSAYALDQQSQCSEYENNPTTQELIQKIKPGCLVDLIQKGILYMAAEQEATDSTTNLSLYGALIQDDLNNLKDNNNISNGSNGSRFALKSEIETNGEQKDSEKQTNNDKDNQDIEMTDALNKEVQQQEIIEFETQLLSPQLKFAPSLTCDWHPTTEVFAYGKDDGTATINAIQDGKIIETRTLTHPNLLNIKNQINIVSWSPQGSLIITCGANSELRAWSPDGKLKNIASTIVDEAISLENTKLISIISSLSWSPTGKFLLSIDSLNQVCIWDGTTISLIKQIKNLEINDDSVVCSCWLSEDKFAVTTNTNGIKIYDILQPPSSHFGNQLDVQPIGLLNGHEHNISLMKLNPVTKLLATCSDFDYSIKVWSSSSSQECLDLNINPEKKYTLKLHAAPMIGLIWLPDSNSNERSLLLSVSMEGILNIWDAKTSENIKSSELFNNKDNFTNELKDDDNNNDTIIKDVLVFNAVLSPDGKYLALGDDYCRVTIWDVDTTHYLNEPKDLIRCKAVYKPEISAEDKLKATIGICDMKWDHESKLICVSYNGMESVIINTT

SEQ ID NO: 20642 - protein, 505 aa, Candida albicans
QDQFEISGKFVRASKYRHVFGQPAKKELCYENLRITKNAWDSNIIQTNGKYISVNWESSGGGAFAVIPVNETGKAPDTVSLFRGHKGPVLDTAFNPFNEQQIASCSDDGDILIWQIPDDYSFHKYLDEEENIKDVTEPIKVLSGHKKKVGLIAFHPCAENVLASTSLDYSVKIWNVETGKDEITLQHNDFVTSISFNYNGSLLATCSRDKKLRIWDIRSGKIISEGSGHAGAKPSRVAWLGNTDRIVTTGFSRFSDRQIGIWDVENIDKGPINGFWQVDTSSGVLIPYFDVETSILYVAGKGDGNIRYYEYINDELFELSEYTSTDPQRGFAVAPKYSVNLKDNEVTKSYKTVLDNSIEPVSFIVPRRAEVFQADIYPDCPSTEPALSAEEWFSGKEVNGPLLITMESLYNGIKPEIHESKPVTVVNEVKKEAEQKKQEEIKLKSEQKEKKSDSQSTSAATASTTKKQEIESTKEGTPGKNVDDLLKTSAQVIFTTGAKDRHSGM

SEQ ID NO: 20643 - protein, 393 aa, Candida albicans
  UNSURE (353),(376): Identity of amino acid sequences at the above locations are unknown.
VQKNLLEVNPDVINAVENAFTLIMNKPESLDTRFDGSDEFNSDQLLTTLQLKSDLFGESSTNLSDGNHSNRNSRLFDDFLSDDDQSDSDGDSLYSDKHSQSMNNSNLEVQFAAPGNLNLAEEIPKLSDEVDNLQKQITILEPLLRKAELTNNLSELKVLQKSKIGLIREINIKELQKQQFIVQENDNSLFGKSRVCIQSYINDNEKNGREFTLYIIEVQKFSNENPNIVKAGWVVARRFSQFYGLHEYLKLKYHRVSYLKFPKKSILVLKFQQKQVAEIRMKQLEDYLQELIKIQEVCSDRAFRSFLSSENFNLKKNQRFEETRAKNYSDTNFQSLFGSKWYRGISNFMTTTXNDENHKDLTYIDTHIMENLRDMXSELKQFDEAASARTPFV

SEQ ID NO: 20644 - protein, 176 aa, Candida albicans
GCSQQLRGSRRLPVVKTNVIDEVRTGVYKDLFHPEQLIAGKEDAANNYARGHYTVGREILDDILDRVRRMSDQCDGLQGFLFTHSLGGGTGSGLGSLLLEQLSLDYGKKSKLEFAVYPAPQVSTSVVEPYNTVLTTHTTLEHADCTFMVDNEAIYDMCRRNLDIARPNFSSLNNLM

SEQ ID NO: 20645 - protein, 452 aa, Candida albicans
IPSIVYPDSITKQYQATNNSENATEEIYPIIESKIVNLDAFNYLLKIILQSVIANHPTITINQIPMLLITPSLTWSRQSIEYITKYVIENLEITAFNIIDLSLAATFGVGQLTNSTVVYVDDENIQIVPVVGYQAIKFAGKLIKNEGSITISRELKQNLPNLTSQQIEDLKNSDIFEVVIDQQGMVLDYIKDITKTNNDEDNEFDVAKIVTENQNGIPEAIISNTPTEQQQKEQQDSNKPNKELEKNYFIDSKTQEKIWIGKERFSGTNNLVKLISSSIYSSLLSIPDIDKRQDCYDNIILVGSIFKTPGLKEAILIKLNQDYLVKEPNAIDQSINDPGVNTAILKYQQSTTINDYNEGGSGDNNNSNSNSNSNQVPNSIKLVKYPDYFPEWKKPKEKGGSWHDVYFLGGQIYSKQIYSGSSHHHGKELFVGSDMYEERVLKVFGMPAFKEN

SEQ ID NO: 20646 - protein, 620 aa, Candida albicans
NYIQLKIMSIKPLSITVPHPSTQRGHATHISYDPVNERLAYVNGKSVIIRPVDFKSTSPTVVFSKHIFPTTAVKFSPSGYYVASGDEAGNIKIWDASPKSEPDFEQPVIKSEFQVMSGPIRSIAWDADNSRIIAVGQGKEKFGHAFSWDSGNSIGDIQGHSSPINVVDIKPQRPYRAATVGDHHALVFFTGPPFKFDKSLRGNHNNVVRDVKFSPDGEYIVSVGSDRVIAIYQGKTGEFVKKIEKAHEGGIFAVAWLPDSKHFITASADNTLKKWTLDGENTQKFEISSTTSVGNQQVGLALTKEFVVSLSGNGNLNYFDHEGNLVQIVQGHQSPITKVEFHDGFLLSGGSDGKLFKWEVGTDGPKALPALQDDDEHSNYVVDILTVDDVTYTTGWDDTLKSWRDGKVVSSVKLPSQPKQLGSIKGAVFVLFESALQLYTEVNFQLIAETKFDFTATYAAPTNDTHILITNTTSNTVEEFQVGNGEIRKTSKEFPKSRSPPNFITVSPSREFFAVADSAGKYTLFNTSDGTVVSTRWAFHNSKVFDAKWTSDSKYLISGGLDSSLLLYSVEKPSRVVKYLLAHPSGISSIDWVAYDSEKKTGTFVSAGLDATIRSWYISI

SEQ ID NO: 20647 - protein, 470 aa, Candida albicans
KSIVHYIGGIQGPVKTEAAKQICQYIAKVSVNQDNVEISKIKDMVLATNPLLESFGCANTLRNNIFSRHGKYLEIKFSEGNYQPIAAHITNYLLEKQRVVSQITNERNFHIFYQFTKHCPPQYQQMFGIQGPETYVYTSAAKCINVDGVDDAKDFQDTLNAMKIIGLTQQEQDNIFRMLALILWIGNISFVEDENGNAAIRDDSVTNFAAYLLDVNPEILKKAIIEKTIETSHGMRRGSTYHSPLNIVQATAVRDALAKGIYNNLFEWIVERVNISLAGSQQQSSKSIGILDIYGFEIFEHNSFEQICINYVNEKLQQIFIQLTLKAEQDEYVQEQIKWTPIDYFNNKVVCDLIEATRPQPGLFAALNDSIKTAHADSEAADQVFAQRLSMVGASNRHFEDRRGKFIIKHYAGDVTYDVAGMTDKNKDAMLRDLLELVSTSQNSFINQVLFPPDLLTQLKDSRKRPENAF

SEQ ID NO: 20648 - protein, 203 aa, Candida albicans
  UNSURE (11): Identity of amino acid sequences at the above locations are unknown.
NRPACTTSTTXTSHTSRPVKKTAPAAPVKKNAPPPPPPTLVKPKFPTYKAMFDYDGSVAGSIPLVKDTIYYVTQVNGKWGLVKTMDETKEGWSPIDYLKECSPNETQKSAPPPPPPPPAATASAGANGASNPISTTTSTNTTTSSHTTNATLNGSLGNGLADALKAKKQEETTLAGSLADALKKRQGATRDSDDEEEEDDDDW

SEQ ID NO: 20649 - protein, 157 aa, Candida albicans
  UNSURE (11): Identity of amino acid sequences at the above locations are unknown.
FPWIVRLPDVXNKCGRSSKRLPRIFIVTKTSIYIIAEVLVEKRLQLPKEFTIPISGINYLGLSTFQDNWVAISLHSPTPTTPDVFINLDFKTELVALLKKLNPGITIKIGPTIEYQKKPGKFHTVKFIIGAGPEIPNNGDHYKSGTVSVKQRLPASI

SEQ ID NO: 20650 - protein, 141 aa, Candida albicans
SCMSHTNNNNNNLIKSFYLKLYHIPIIIMGLLTIIKKQKLKDNEIRVLTLGLDNYGKTTIIKKMLNQDINTISPTMGFQINTLFYTPKNNNNNNNNSNSNDNDEYTLNIWDIGGQTSLRSFWANYFDKTVSPRRWNVPHLV

SEQ ID NO: 20651 - protein, 660 aa, Candida albicans
RGRRSFMISYNGNNDNGRYHKVLRALDSINEKSRMEFDSPDNYSPRKLTRKPPQPANFKRFELWLNVVEKTIDARGKFRNSDVGASDELKSAYAGTRGSVITTRNQLENHLVEYCIATMLLINVIVGNGTDYRVRIHLRAQFRAAGLDRIIHKFLELGNEELDNMITRHKIDANNDEEELKYSANFNNEDNEVDFNDPVNLVQSLWQSVKNSDAEGYFLSAIQHLFLNQSEKRGNPEEMNRSLRVLDGLIPNISSVRTVSEDTAINVAINKLISNMSTDDMYRKALEDVKIYRRIAEEATAERDDMSRQLSMGADGYINSLLNDVKERDMVISRFRRINEDMKEELEQMKTKYMQEKQELELEMRELLIMLNNSEIGANAVKKDGGKTTILISTSNEELAARLKKQIHRRRAEYKLDNRQLGTNVEPLSRLRALRDQMGDIENMARELEMTDFETYADPEEEENNNDQSPEKSEIDESRSSQESEAEIQSVEEDEEEEEKEVVIPPLPVPSGPKRAVRNDDLVRLDHLRKKLANLQSESNDIMKYNSSSMFNKQKFLAMERLQELENNFKDFNIDFAVSDPEDKYNFNSNAGSVDDSIKNKTKEVLAEAEQIREELRRQLAAAQKIKSPSPKRNTVLERIENKYVKGQVKIDAPDVVSNL

SEQ ID NO: 20652 - protein, 604 aa, Candida albicans
NKIPRPKKKLKQLHWEKIDHSQVGNSFWNDPNTHTLVDDLMSKGIFDEIELIFAAKEAKKLATKKKEDLDKVTFLARDISQQFSINLHAFNSFSDEEFVLKVLRCDKDVLTNPAVLDFFGKEDIVEITNTLARNFEPYSTDYKTEEITKPEKDPNELQRPDRIYLELMYNLQHYWKSRTRALNVVVNYDKDYVEYVKKLRLIDEAVDSIKNSKHLKGVFEIILAVGNYMNDSAKQAHGFKLSSLQRLSFMKDEKNSMTFLHYVEKVIRTQYPEFLEFINELSCCNEITKFSIENINNDCKEYARAIKNVQSSIDIGNLSDVSKFHPLDRVLKAVLPALPRAKRKAELLLDQANYTMKEFDDLMKYFGEDPTDQFVKNSFISKFTDFMKDFKRVQAENIKREEELRVYEQRKKLLEKPKSSNNGDSNALDQDGESNEGDGGVMDSLLQRLKAAAPTKGESASARKKALMRKQILESQRKRTTGSVGSPTNVSPTRNNESDSGVDNKDDTHGSSPLDEQFHDSITTQEDRIRDDNRPPEGVADFSNVEDPENPDVGARAKNLLQELRGADESSSKLSDAQRYRQERLKKKSVQIDLDEVAKNNNSE

SEQ ID NO: 20653 - protein, 232 aa, Candida albicans
MSRSVKNITDSLERGKLINKKDLHPEERILTTISSPMLNAKNKNAMLQSHLKRTAGELNSLMTFFGENPKDATARNTFFYKFVTFITEYKKAHVENIQREEEQRTYEIRKKILEDKIAKKEKLKEELAEPEAVVDTAEESSAVIDSLLEKLKSSTPITTNRAKTKNRRSKALSFYSENPLEIVADTKYESVNNLKRRMTTRKRTTDGETSPKSEQFMLRAQAMLHQLRNKEE

SEQ ID NO: 20654 - protein, 1290 aa, Candida albicans
  UNSURE (56),(60),(62),(65),(66),(109): Identity of amino acid sequences at the above locations are unknown.
IFLPKHPYPGKKLFLKFLWVPKKHQNISKKIPKFQPMTEPPPQRKEGFCPKGWKKXHESXSXFNXXEPGKTNPPPENFWWLDLKSNLNSIGVSLVGYGLSRDHLPPPRXDTDSESVSSRTSSPTLHVTTKFNPKQRVESFQTATNFKNQIPPEEIVDQLFEKLLSIRVFPDEAVYSLKKQPVERKWELLLREHETNHHFDLKKLSEQATDKFLTNRDRFQEHEFLIMSRSTTQEPKPKLKPLRIVSGGEDYDDEETPTVTKLVHDDSSTSKLSIESGGSSGAPTETESLLGLVNKKLKIRDGSPDWYVSRIMANKLSLKDCKKLERKLVENNVVKNSGVTWTQGFINAQGETALSVVLTKINKKSIKSNEEFDKEYLIVKCLKHINYEKRDETLSLKEKVYVVKALVFLLVSPRLTTRILVTEVLVMIMLLRDKTLWKSALDGLSSLQDRNGDYVIFQPWLNAFEETIIKYSWSQNKAGELSNLKNYATITLILINSMVDMCSSLKRRISIRRDFGNARILNIFEKLAQIEDTRIDNEIEKYEMYAEEDYNEYVEGKKKRNSKQLPNIPQSKLKLLQVSDFVTTPEANTSLEEDELTPELEDNLSGTESSFDEKSFMTKLKEAEDIESDGTMKSVLHRLMKLKQSERSTEDVHNMLVLVDSMLQHVTNESRVIGTDAHSVLNITIQKLMDRLSTEDMARRAVAESKMLSRQLELVKEEKELLEKELETYKIETIRELKKENYYQAELIATQERQLYKLQQKIEQLQSPNNTALPVVDVGQQGFGNGTVASLKDTSSSSPSKRPPTPPGLYSMQKGSLRGGISAPPMLDFKDARPVSDLQDSRPVLDLQDAPRLVESSAPPLPESKDPVAQPPPPESKDSVAPPPPPVPDFIKSAAPPPPPLPGFMNASAPPPPPVPEFIKSSAPPPPPLPGFITTTPPPPPPLPGFITTTPPPPPMPGMLQPGKVKELGTLFKEKHKQEPQKGITKTKADVVPSIRPKNKLKQMHWDKLENIEKTFWNNLEDSVLSNKLIEQGVLGEVEQVFAAKTATIKKKTAVESQQQPTKKSFLSRDLSQQFGINLHMFANLSEEKLVLKVLRCNSEILENHSVLEFFNNEALVELSDSLFRNLAPYSTDPRTRKKPMKNPEELERADRIFLELCYNLRHYWRSRSRALLFLQTYKKDYIDLMRKLNIVDEANAALKKSESLQNVLGIIRTVGNFMNDDAKQALGFKLDTLQRLKFMKDDQNSMTFLHYIEKIVRHSFPEYGSFVDDLNVLSTLHNISIEQLETDCE

SEQ ID NO: 20655 - protein, 333 aa, Candida albicans
MPKGMTKNIVGGDNFEEKIYQLVSQILDETIGFFQNLKSEKLNKFDDIDDKIDAVIDGNYQLQTSLKSLGQYIDTLTANTNVIKVHKNGNLEELFDDEMQQTVDTISLASKFLNDLMANPQLYNGNGGNIEVDEMLLACAKAITDAVAELIKASIKSQQEIISKGGTTKSDFYKKNSRWTEGLISASKAVAGATNVLIHTADGVLKQSNSHEELIVASNEVAASTAQLVAASRVKANFVSQAQDNLEIASSNVSKACKSLVVKVEGLLIRKDEEGEKEKENIDLTKLTPYEGKTLEMEQQVKILKLENSILAARKRLAEIRKQEYKTPETVFD

SEQ ID NO: 20656 - protein, 666 aa, Candida albicans
RLKYGYRNRDFIASLATVFPSHGSAYGRLINQYDKYILQKLDFHRNNPGFNGTFEYEEYISLRAVNDPNEGYEALLNLMDLQDLINDLQKLIFATINQSHSNLCKVSALVPLIAESYGIYKFCISMLRAMYQQLGEDDALSGLVERFDSQHFMLRDFYTDCHAIKFLTSLITIPRLPNSAPNLKVTDDGQPISRPRSVSTTDTNNNNNNTNNTTPQLSSQPTSQFEQPPVAPAIDQLVGQQTGYLYQQQQEQERIQQQLELQRQQQLQQQQEQQRLFEQQQRDQERRFMEEQQALQMQQTQQQQHIGRVSELEHDLLMFKNQYDNDQQLLQQYDSRVKSLENEMSALNSTATQQIASKDEQIKNLEDQIANWTKKYESLAKLYSQLRQEHLNLLAKFKKIQQKISSAQESIMKKEKLEKDLKAKNVELADLIRERDRARLDLDRLKANKDQEIEKLQAEVRELTLTQQESGKLQSLNLSSIMTKHQSELDKLKNQLAERELKLTNLGDSEQLQSKLRDTEMELQITNESLDNALAELHRTTEDQDDIINAQIDHILLANVEKFKNLIDIFLENSVKRVLDTKHELVSPVQAGNLNASPEYVLSIIELCSDTATEFATIFNSFIAEDRNEDESSFSDIILSTSSLTSSINDLTLNAKGDDQKYCWWG

SEQ ID NO: 20657 - protein, 581 aa, Candida albicans
FWYKLPVSICCRLSFSLKTPYCSFQQLQQFNDNSKNMSTEESQFNVQGYNIITILKRLEAATSRLEDITIFQEEANKNHYGVDSLTEKGTPKSRTVESSEATSDGKSLESTSFATFSEAPVEKSKLIVEFENFVESYVHPLVETSKKIDSLVGESAQYFYEAFVEQGKFLELVLQSQQPDMTDPALAKALEPMNAKCTKINELKDSNRKSPFFNHLNTFSESNAVFYWIGIPTPVSYITDTKDTVKFWSDRVLKEYKTKDQVHVEWVKQTLSVFDELKNYVKEYHTTGVAWNPKGKPFAEVVSQQTESAAKNSSSASGSAGGAAPPPPPPPPPATFFDDTEKDSENPSPASGGINAVFAELNQGANITSGLKKVDKSEMTHKNPELRKQPPVAPKKPAPPKKPSSLSGGVSSAPVKKPAKKELIDGTKWIIQNFTKADISDLSPITIEVEMHQSVFIGNCSDVTIQLKGKANAVSVSETKNVALVIDSLISGVDVIKSYKFGIQVLGLVPMLSIDKSDEGTIYLSQESIDNDSQVFTSSTTALNINAPKENDDYEELAVPEQFVSKVVNGKLVTQIVEHAG

SEQ ID NO: 20658 - protein, 408 aa, Candida albicans
IIYTSSSLPYLRKMPRLEESEIKKYWQIFQSLKPQNNKLTGDQLSSILKNSQLPQQQLSAIWELSDIDNDGKLDFEEFCIIMRLIFDVINGKLPNVPQELPSWLIPASKSAIIQANKAVNQGNNNFGDIDDDEDDKLSNDFDWYISPTDKSIYEKIYDSKCDSFGRIKYSSLNELYNGLTNVPSSEISSAWNLINPKSFETIDKDQTLVFLHILNQRENGKRIPRGVPASLRATFSKEVPNYDLLAQAKPSISATTETGKKSFAENYLNKIGGGVGASSTINNGRNEKGTDFSATQGTDWEEVRLRRELQDLERLLDKVQNDTKNQKDNSNNNQDNNDMLIKYEFEQLLKYKQNQLNSTTNASKNSTDLSSVKQDIEEIQNQVNTLQEFLTTKNQELLKLNQQIESLK

SEQ ID NO: 20659 - protein, 378 aa, Candida albicans
TIMVLGFGSLLGSPQGRSQAEAPRPEFTPIGKRSGSTSSFQVYHSYPQEQKTQTSPPRRKLFRPLADSNLAAHYSHDSGLFDDTVEDFEKLSPIRPQRSPIAQRNRRSPDRHDFITDDSGGIAARQLEETIKELRLENYGWKIKYKELIRSLENMPAHEREVRKENIQLKEKLATLHQHIQQLESQIAELQNNKENITTNNNDSREKDNIIQQLNNKIYELQRQLSSENKLKESQLENEEIIQALKSERNELTAKVSELEDYMKHSEVEFDVVMKQNDEFQERIHELEAAIDTLHQTEATIQQQSQLRENTELQLQKLSTELDKQQEMNRLLASKNENLEMDLSEKTDNLPELNNKVLSQAQEINLLENKLDTLNSPI

SEQ ID NO: 20660 - protein, 328 aa, Candida albicans
TDNKENIFTEKHFDNISTPISKKHNPINSHHPLAVISEVEITTSNSVSETPMPLPEGKNQRKQQQETPLPLPLSLPKQQQDEREVSGDESTPHFYHPHPPKLNDEGKIEDTEDNVEPKLPMSDLSSMISGMINSLSHTYTSDSAKLDLEIFKLKESINLKQQENQESLTRVQKLLINSGIQELQIESIEQGQELIIETIEVCERTIKEKEQELLKVLQHNQSIELAKLVEQHESRYLEEDKKNHYENSHNRDDDLIDQSRIDDAIELSKLQLERNRLVNEIVLHTKSFGIDEKMYKYRKLLSLSCGVKVEEIDSLIDGIAESLTEGMT

SEQ ID NO: 20661 - protein, 129 aa, Candida albicans
ATETLECDKWKIKYDDMKEQNDLLQETLRNCFAQNQESNDTVSQLMQQHVEQLNTIKSELNAERKKTTSLEQTNLKLQSEIEAKELSMKLEEGINYCKRMFEVVGETLKNGVAVTKGVGVQIKDISEFT

SEQ ID NO: 20662 - protein, 139 aa, Candida albicans
IYNRSIKYNCRIIMSWQAYTDNLIANGKVDKAALYSRAGDALWAQSGSFELQQPEITEIAKGFDSAEGLQTSGLHVQGQKYFLLRADDRSIYGKHEAEGVICVRTKQTILIAHYPSGVQPGEATTLVEKLADYLINVGY

SEQ ID NO: 20663 - protein, 328 aa, Candida albicans
ITQARLAIPVVKDLEQPKPSSSTNKHDQDDENEEELEYYIDEEFDEQKAIVTKDFRARMRYYKRRILPNSRETVINFNKRQVSEKIEDHNDPNKKEWINPDKQTNKRFFVGEDALNLATKNPNQVNTSKDGESQWILRYPMINGNFNENSYYYESREEILGDICNIIFDALNQLEITTDVNKYKVMLLIPDLYDKAYVETWCQLLLKFIGFGKVGIIQESIATTFGATMSTACVVDVGAQTTKISCVDEGMIISDSRVLLNYGGDNITETFVKLLIEDQFPYRDINLINAIDWELAQNLKEKYITFQDADIAIQLYEFYKRRCSPWEE

SEQ ID NO: 20664 - protein, 263 aa, Candida albicans
  UNSURE (3),(5),(20),(24),(61),(263): Identity of amino acid sequences at the above locations are unknown.
LMXSXAATPILSSQADDIIXPSEXPDSPTNPNATVLSSSTTTNTATNKINAGVPPQPSTTXSSSSSSSSGGGVIGDSESSAQKRHKPGPTAGKRPSAETLQRRKEGRIKAAATLAQNLAKTGIGRFENENGFNLTSIKPILVINQKNYFTDYLKKDEQVSFIRNWRQERALQQKMKKLKQQQQQNNQQNNQQQLDNGEKKETKNFDDFNLNDIELEMKKEMAVSGGTTTTGAGNDDDEEVDDEENETEEVRLHHALEGPSLRX

SEQ ID NO: 20665 - protein, 191 aa, Candida albicans
QHLLNPPIINDYVKTMSTVPQVTQDDYTETLKVWRSFKVAQLKDVCRSLELNVGGRKQDLVDRGEAFLSSKFNNNDQIGFHAAKSLIFMRLQGDPLPSYRDMHYAIRTGRFKLTAPTLIGTSSSTNQLSNIHSGDSKPYKGHTLYFKATPLYRFLRLIHSTPMLLIPNGRNSVQTCHFIFTEEEYKFFQDK

SEQ ID NO: 20666 - protein, 165 aa, Candida albicans
  UNSURE (2): Identity of amino acid sequences at the above locations are unknown.
SXCRLLKTPHVELYILCGIPDMQRSNATNNVSIEYPVETVIYFNKHEFKDTFRGISGETNTAVPVDITKYINSPPQRNEIVFCHLANNAGYMMYLYLVEVIPAERLIEQVQNRPAIPKSETIRNIKDMSRYDGIQTTKLPLRDPLSYTKLANPTKSVHCDHYMCI

SEQ ID NO: 20667 - protein, 520 aa, Candida albicans
RPLSAGGAGAISHLVGKAIVDKLSNYAINYQQQSIEFILSNLDITDDVSISKNHTILLTLGYLCLNKTMSKQYIGKLLNIVHATMFIKIRTHSQKADLGNCIRDSSCFITWAIIKNQKYQNELLETTDQLTTIFTDLIKLLIFDQELLLKKCSIAVLQELIGRYGQQIFQNYYVDKELLGAFIINFMESFSDLRLKQKCITFEMIDLMYDKIDLKFLLPNLLDEIYDNEDSNDELGLYLHKLLTQQDNLLSVVQYNYNLDEIKLTLIDKNRWKYLYDLPKVPYQELSEKFSNFNYHDNSQLLSGYLTFLLNKIELTDLDWENLFQIIKLNDGKFDSYIGKIIRSQNTIPKNSILHLLMKNNVTLSTTIFNFQNWSTQDVEFIVNIIKNPNIDIEIRRNLIYNINDNYTTYPIIEQMYLLFDDYTLTVQGDIGSKLRLAMVELVQQHNLLNDTIKSKLIRLSGEIIDKIRLSAFQLLVDATVDGNKYWQDWFEYYNSLNNDYEKIEILGSVFFQLLGNFKM

SEQ ID NO: 20668 - protein, 197 aa, Candida albicans
TTIMPIPPTSTENKNLDEDILSSRLSRYNAIQPEVKQYLYDILSPKYPDLFNHKFSIDNTTSSSSFPAGKFLQDIDLRDLLKDGELLCKLGQLLGRNNNIIPNNPTFKFKNSQMAFHQMENISFFLKLCELIKLPHDEIFQTVDLFDGKDPYQICITLMSFSRIVHDLDNQVFYKVIGPKIVKVKPTVPIKPYKLRA

SEQ ID NO: 20669 - protein, 403 aa, Candida albicans
KVKKERRGKKKPANVLGAFFQRETQREREKKIFFNHNNNDQNLNYLTKSIQFKHFVKPKPNKFIINLAMYSRARKSQENSTNGNIDEISSYNQHQSHNSTNSNNNNNHHHHHHHHNHHHSHQYPHTNTIPANKDGKRYTMNEVFQVWYDNKDQILNNSVPVGADEPYKLSKPEPIYHLDLQSNLTKSEDYQLETTKEVTDSLDKLTIGADSEVDTATQPSTATGGPSATTGTATISSIQQAPPGMSQLHKDFPSADSKFRPLVTSDKIEWHYIDPSGNEQGPFNGDMMQDWLAGGYLNLELKIIRKEKGSFTTLRDLCESLQNYVTPFKVPLPDLTAPRGGPGTSNDNVTGNGVRTTNGVGGGGSQFFSDDLLGNSFPNFQSNLLSSFGSTPTEQFISSEFVW

SEQ ID NO: 20670 - protein, 269 aa, Candida albicans
TKVINCIVSTNYTRTMTYTAPAVVIDNGSYTTKAGFSLEDLPSLVFNSNYMKHDKTQQVIIGDELMENNSEQQVMKLLDDGLIYDFDNIVYNWQYVFDNVDNNNPINSSEFPLVVTEQPWNTSKNKVNSCQVAFETLQVPIFSLVKTPLAQLYRCGKSTGLVIDIGSSVTSVTPILDGVIQLKCSYHSKYAGDFVNLHVLNYLESKTAINSLLPSKFANSSESFKQYYISRNILQEYKNLSLNYQIKDYQLYNHEFINVSDRPNYLGSR

SEQ ID NO: 20671 - protein, 217 aa, Candida albicans
  UNSURE (15): Identity of amino acid sequences at the above locations are unknown.
RGSFQPPWVKTIHHXEPPKEIPDVDDKKPDDWDDRAYIPDPNVEKPEDYELKHEYPQIRDPNAVKPDEWDELAPRYIPDPDAVKPKDWNDAEKQWEPPLIVNPKCATGCGPWEAPLIPNHDYIGPWFPPDIKNPNYNGIWTPRLIPNPDYYQVKTPGKLDKPIGGIGFELWSIESDILFDNIYLGNSIAEAELIGNTTFKIKYELEADQRRENKPRV

SEQ ID NO: 20672 - protein, 255 aa, Candida albicans
KEISCSHKCRRTTQYNLKTSTTLQSFSNFHCILKYLLFSLMSKFFKSFTNKYSPLSQNDNEDGAPLPPPVTQPGAAPSNQSFKTKLQQLNPFRSQSVYLEDDENYVTSDPGMFELLRWDRMLIFALCFAGSVCCYLIGIFLFRILSLKPRKFALIWSIGSILFLVSFGVLQGFKAYMIHLFLSTRIIFTIVFGASIILTLISSVSLKSTLLSIIFAVIQLLAALWYTVSYFPMGKQTLNLAGNVARSQVDTWISS

SEQ ID NO: 20673 - protein, 116 aa, Candida albicans
SFYLYYNMSTESENVFRQLFRNWNDRSNRTTTSSTSNRPVLSEWTDYFKTGANDLYNRLPSSVQDIGATNNNVQEPSWYNLSRLERLIGFGCCLGASVLCFVLCFFMLPVLALKTN

SEQ ID NO: 20674 - protein, 113 aa, Candida albicans
CTRAIMVQFVKTREINWFWVLSWSICVMLCVVFLHVAGFGIKDQLKFGLLWTGGSVLFVVSFGVLQGPYNYVRHLLSRDRILFTGVFFSSVFLTIYSACILKSSILTIFTTII

SEQ ID NO: 20675 - protein, 169 aa, Candida albicans
SLYRRFHSRHHRLYVPYAFGALYNDPVEGFLLDTLGTGIDSLVTGLSHRESIFLYTFATLKTVDDHCGYRLPFDIFQIIFPNNSVYHDIHHQMWGIKNNFSQPFFTFWDVLNNTQYKFVNEYKDLQKHITLTKYKEFLAKKSGSKLKSKQELEIEEEEKSIDKETKKEI

SEQ ID NO: 20676 - protein, 254 aa, Candida albicans
NHIIHLFIGEMLILKRYPPTILEDLMHHDKDVIVPNVWRHLPDWLGNQQPYDLNSWQESEGGLQLADTLDEDACIVEGYVEYQTWRPHLAYLRDPYGDPEVEMDLDGIGGVSILTKANVFRQGSHFPAFSFEKHAETEAFGKLSKRMGFSVVGLPHYVIWHIYEPSSDDLKHMEWMASEEVRQQEEAKIKKVYDKVWNKAFEDVQNNWDKERSKFLKNTDMSNVRKIKVDWSGVDDFDIDKNSHDDKKLADFNP

SEQ ID NO: 20677 - protein, 101 aa, Candida albicans
  UNSURE (28),(75),(78),(95): Identity of amino acid sequences at the above locations are unknown.
QLFARNRSVIQKLMFFTALMVVFPLLTXFILQYFTDNSIISGRVAALAANVVLISYIIVAFTEDTTKLDEKDESXRDXWVLLYALNCVMKTLPDXRGPRLD

SEQ ID NO: 20678 - protein, 192 aa, Candida albicans
QDIMALYYNLVFGLLVFEMIFFGVLSLPYPRKIRRSILSTVSAPFKNEQFQIAIKCILGFVLVLFIDSVNRVYAVTTELHSSTASPGSTAVVDRSEVQARRFYVQRNMYLCGFTLFLTLILTRTYSLVAELIATKDKVDDLKSTETVTEDSVTVAKLKKELAQKDEDLEILKNQAKSLSSEYEDVSELKERK

SEQ ID NO: 20679 - protein, 240 aa, Candida albicans
IIHRDCVLFYNFFLLSFFQKNNKTIQISSYQISKPSRRHCLPTITTTITTLANTMSLQMSLVFCTLIGQMITLLVLVLPLPYVVRQKIVDLTFVLQKSQNFRVGIVFSIILMSLQLLDCIQRLNKYADAETNPHFPGIDYDRLASKFYSQRNLYLSGAVLYLQVAIGTVVTIVRKMVLKEKLYREANIKPATDDEATEIEKLKHLIELKQQDIDTFKKQVQGLQKAYNSLTPEEKKNKNE

SEQ ID NO: 20680 - protein, 323 aa, Candida albicans
QSKQVFTHIHIMSLVAIKNGISKLVLSKDASDAELERVERLIDSNQIPYGSTDSNDERAQQLAREEAIIQAAASISAASSSENKEEEGVDSITAFFNTFDPRVMSDIIIGLSDGLTVPFALTAGLSSLGDSKLVITGGMAELVSGAISMGLGGYLAAKSESEYYFSQVKKEKLEFFKKPEAINQDAAEIMFELGASEQTIISFLKDLDAKPKNLIDFVIRYGKGLEEPAAGRELTSALTIGASYFLGGFVPLLPYFFTKEVGTGLIISVVAMLVVLMLFGYFKCSISMGEGCPNHKKFAAGFEMVVVGSIAAGAAWGLVFLIE

SEQ ID NO: 20681 - protein, 411 aa, Candida albicans
  UNSURE (16),(43),(106): Identity of amino acid sequences at the above locations are unknown.
YNFKVLVKKKTLADLXTLIELWDLLLYNISDIASELELEAKGXETFERSLVTLYDKSHNPSKAVPHLIHLRDPNIIGYLSTNHILVPFVSELPVMIDLMFDKGDLXTLPVSKIEKRLQGVISILVDHRLEIPAKQIVNLFYESGLSFVSFFYLEKLADIDNFLVQGFGNERVKLYADYKREKLLPYLTKNDDYDIDTAITICETNDYTKELVYLLGKIGENKQALTLVINKLEDPVMAIEFAKHQNDKETWDILLDQSMSKPKFIKALIESSDESSNAFYDPITILQRMPQDFKIEGLNESVIEFSKNNDLNMLLNQIILKIIYKQSQETSEEFKSQKLRGFEVEIDKKIKKMIQQFQTIVAFVRDDNVKGGPKMVDIKLESDLTSDYSMVPYRDLAQKLDHLREIEENYF

SEQ ID NO: 20682 - protein, 220 aa, Candida albicans
  UNSURE (207): Identity of amino acid sequences at the above locations are unknown.
FFVKDPVSTSTFHETVFIFATHSGIIHICKPNFETIRTFKAHRASVLSVFTDGTYFATASMDGTVVIGSILDEKDIVAYDFQRPVHAVILDSNYYKTRSFISGGMAGQVIYSSKGWLGKRSDFVLEQGHGPIVSIQLIDDLVIWMNDKGISVFHLATRQIISVLEKPEDSPRSDLYWPRIAFPDPDRLIIGWSNYIWSLRVSLKTAXDEKEGTPISSGNE

SEQ ID NO: 20683 - protein, 298 aa, Candida albicans
PMSTITIPQDIEIGGSTYYQINIKLPLRSFTIKKRYLEFQQLVLDLSRSLGIDSRDFPYELPGKRINWLNKTSIVEERKVGLAEFLNNLIQDSTLQNEREVLSFLQFPSNFRFTKDMLQNNRADLDSVQNNWYDVYRKLKLDILNESSSSISEQIHIRDRISRVYQPRILDLVRAIGTDKEEALKKKQLVSQLQESIDNLLVQEVPRSKRVLGGAVKETPETLPLNNKELLQHQVQIHQNQDKELDQLRVLIARQKQIGELINAEVEEQNEMLDRFNEEVDYTSSKIKQARRRAKKIL

SEQ ID NO: 20684 - protein, 286 aa, Candida albicans
  UNSURE (46),(48),(125),(129): Identity of amino acid sequences at the above locations are unknown.
FALFNPWGMPSFLQTTNSLFMTIKDIKFTISKIKFNLDEIINLQEXRXNIYDLDLTPSKNDNFEMISLILKTRQYFTLIEQDMNDYFDNLEKNGILDEFMNLVNQYTKIFEELSNDTNIDISEYXYVYXLPTPSQNGTEANPVQKSVRFRDTPDDNDASELMGTRHTFQPYKDDPDEDSSVEYEDISDHQMFAQHQQTLMRQDQELDVLHQLISRQHMMSQDINHELDDQLIILNDLEQGVDLSLGHLNSANTRLRHFRTLMRENGSLVTICTLTVILILLLVILN

SEQ ID NO: 20685 - protein, 211 aa, Candida albicans
TTTIYIYIYTYLLSIMSVPSILATTALLTVGGYMLFTGAGESFNIGEFLESTSPYMWTSLGIGSCIGFSVVGAAWGIFITGTSILGAGVKAPRITTKNLISIIFCEVVAIYGLIMAIVFSAKLTSVPSKSLYTKENLYTGYSLFWAGLTVGISNLICGIAVGITGSTAAISDAADSSLFVKILVVEIFGSVLGLFGLIVGLLMTGKAQEFS

SEQ ID NO: 20686 - protein, 224 aa, Candida albicans
SHLASLASPYIMTSFELTPTLKETINASSLSKDQKQKLLSNSHLTHADLIKFYQTCHPTSTLLQLIQQTKLYIPPYKTYIQPKTSEFIKTMEKLRLEAKEQEYRRLINPTPQYSTLYDKKLEDYDLAPTPQQALKELKNQLTTIINVFISVGSVSYAIWYWTETSWGLPVSYRALLSVFFGLLVLVAEVVVYMGYINKIEDARDKERKKKEVKKVVRSINLKLD

SEQ ID NO: 20687 - protein, 238 aa, Candida albicans
KMSSHTYSPSRTISSPLLSLSSWRQFQLFDYTPIRDPNYHSSHALYSDPTLSCITATTTSYLIIAINHCTIKLINLSDLTCQLTFDAYNIDYRITFIEPIHNSNNLFVTLAEKQGMPSIIKLWDISKLLNLANNENNDSSKNSKLDQSEYRFEFQTQVLVNDHSSGTTGIGDNSYPISCFKFNYDLTCLAIGYTNGKVILVRGDLLRDRGAKQRLIYNSGNNDPITGVQFNETEQVLY

SEQ ID NO: 20688 - protein, 275 aa, Candida albicans
ASRENGNEIDLFMSCQLNQDVEGCFEILEKYGDTKPQLYELMLKFIISSKTIFDQIKYEDIQVILEQIKIYKLLTPIELVDILTENPDNEFITLGLVKDYFIDYFQQQTKEISNNTKLIEKYEQESTKNSFKLSELSKPFVIQNNKCSGCNLKLDFPVIHFKCKHSFHQKCLSTNLIATSTESLTLSTPTSTSTSMLNPNNNVVINHNDDDKFTCPICIHKFNDIKNAKLNQYKLGDAANQNKENFDVFINSLHSSNDKFKFVSDYIGKGVMEDQ

SEQ ID NO: 20689 - protein, 177 aa, Candida albicans
GLAFVNKFYQDTSLVILWGEYPALFNVISCIGWHAVTVIPCAQLLNSVGPLPPWAGCLILVGCTSIFAVFGYKTVHLYEKYSWIPNFIVFMIIIAKFSQTHAFNWGEKKSGPTEAGNVLNFISAIFGFMLGWILYAGGLYPYIMHANSNQWESRVYHDHRVILTSDVYSNFGSSNRN

SEQ ID NO: 20690 - protein, 234 aa, Candida albicans
PAMFTAILGAAIGTSVNLKGSRFEQAYNKNSTGGLIYEILCGDNNNQGYRFIIVVFALGAIANGIPGSYSLSLAIQCIWSQCARVPRIAWCILGNLVALAFSILAYYKFQDTMSNFLSIIAYNVSIYLSISLTEHFIYRRGFSGYDVTDFNNYKTMPVGIAGVVAFCFGICSTVLSMNQTWYQGVIARKIGDNGGDISFEMNIMFAFIGYNLVRPFELFFTTGEWPDPTYKVGE

SEQ ID NO: 20691 - protein, 137 aa, Candida albicans
MLMSSPLHPTIEQPSTSNSSLKRPTNWADKIGLRINAEIRGIERVPESERHDNSLLSPFLVFLSPHMVISGLSIGSLGPVAYNLDFRTSIIIITIFCIIGSIPVGFFSAYGMRFGIRQQILSRYFTGNIMGRISCFV

SEQ ID NO: 20692 - protein, 326 aa, Candida albicans
FAQMSSDLEQTNNPPMRGIPAITGPIDYTKAFHVFPKELQPFRNSIIAYGASLFSTLVGFPLDTVKTRMQTHKNFTSYFDCVKKKYAKEGVRGFFRGIWAPIISTSLSKSLSVSLFTTVKPYTYGLLYETPWTKNIESSHPFLRNIPVCFISGLIAGGGVSLFACPFEFTKVYAQLEKLVASKSLKELSNLNNNGGTSSAQLATKFNSVKTPSTAVIVKEILKYEGIKGLYSGYKYHLMRDSISTGFYYSIYESMKWSINNFINKDPSISSPFSVLLAGGMSGVFSWVLIFPIDTTKSMVHKDAVDNILRRSHGLEPLTPRLRKLQ

SEQ ID NO: 20693 - protein, 291 aa, Candida albicans
NLDKTENMDDVDSALADNVKSFAAGGFGGICAVLTGHPFDLVKVRLQTGLYNSSVQCVKQTIAKDGLTGLYRGVLPPLLGVTPMFAVSFWGYDVGKRLVSTYTGKSIDQFEIKEISTAGFISAIPTTLVAAPFERVKVMMQIQEGNKSKSMAGVVAEMYKTGGLRSIFKGSVATLARDGPGSALYFATYEYLKKELSSPGEDLSLFAIMTAGGFAGVSMWLGVFPIDTIKSTQQSSNVPISILQTTKNIYAKGGIKAFFPGVGPALARSFPANAATFLGVELARKALDLII

SEQ ID NO: 20694 - protein, 241 aa, Candida albicans
PNRNSQSSILFQAVSLAVFLEASPEAISGAMNALLMLLTSNETNTRYLSLDALIKLTARSNSNYLSSLKDNFDKALNIIMKLLRDKDISVRRKALDLLYTICNFENYNIIISKLLDYFPNADFLLKSELAIKIAVMAEKFATDSTWYVTTMLKLLSIGGGSNSNGVGFMSNEVWERIVQIVVNNESLQKKTCKLLINLLRRPFDQRNVASPLQHQQQQPPPPQALPLSESLIKVAAFVLGE

SEQ ID NO: 20695 - protein, 251 aa, Candida albicans
YYSPHYSFATYVNTMLKSQPKSQMKGLTQFIVDLRNSKDQDEEDKKINLEINNIKTKFNNNNLNGYQKKKYVCKLIYIYLIGNPNLVDFGLKESFQLLQSNIFSEKKLGYIAVATLLDNEKILINGKNQKSKKFTSSKQRLNYILENIHTDLVRDLQSNNEEFNCLAIQFIASVFTINADSDNTIIKESDENSHLWLELVDMVYASVTSPISSPIVKSKASITLKSLLKLYPQVIITNNNWIPRLLKLIGR

SEQ ID NO: 20696 - protein, 318 aa, Candida albicans
SVLIINFILIYIYHQPIILALHYPFFFVFFSYPSNLSREVLILFHFYHFGFCFLFFLMTSHFPPNTKIKDFGYPETHPFHIGNYLLKSNGSISSSPTSSTTSSSASSSSTTSSSAFISNKHGNHHHHHHHHHLPNNYMTNSSQFILSNDYNNTNNINDDDDDDDDNDNDDDIIDDDYDQDEINCKARAIFDFSAENDNEISLIEGQIIWISYRHGQGWLVAEDPILGENGLVPEEYVEIMQNLDNKNKKKHKNKSININGDYQEFGHQYGNASNNQDEDVPKRFLPEIFNDHIHQDDDDDNVACHSVFTIGPARTELM

SEQ ID NO: 20697 - protein, 294 aa, Candida albicans
QFLNVVRAHQKDAYFESSYRTQLQELFQFLKGQRFVNAYPQEITVLAKAVYLLLTTLLGARTLGEEYVDLIYVNRIGNRLPKLLPRLGFIVSYALVPYIISKIVKKLKNKEDDWVSEALSNYYKVLDTILNLHVALFYFQGEFYSLSKRLFGLRYAFGHHKEPEKMQGRNYSLLGGIIVLQFIVKSLVGMKSKEKKQTEDTTEDAKIRSINQLSQLSENYSAEYIIDLSDEKQLPYLPEASRSCMLCLSPMVNPSAANCGHLFCWDCIVDWIREHPECPLCRQQCLEQHLLPLK

SEQ ID NO: 20698 - protein, 704 aa, Candida albicans
LIPLLTGEEDALPYFADVVKNITNSDLKIRQLVVIYLTKYAEVEPDTALLSINSIQKSLNDKDPINRANAIRSLAGIRIGSIIPILVLSMKRTSTDRSPLVRAATAISIGKIYQISGRSKRQMIEYLSKLLTDSEVMVVGAAIKTYAKIRMELNEEKRWTPIHGNFRRFCKLLNQFDEWTQSYVVELLTEYSRKFLLRPINDEITDDDLELFLRSMKPLVQSISESVILSVAKSIYLLAPRQLFCDFQLDLVLTRIATSLNQLDVSLFALEVVSFISKSDKLFESYYKSFYVTPSDLNDVAICKINILSALSNQENFKYIFEELKYYAIYSTNKSISKESIKAMGKCSGLSLEWSQKILKWCLKKIKTSRGETLNELLTVVRYLIQQKSDSNDSLNKAEVLKTTFNLAAILEDSLVELETEARASIIWIIGEYTALAENSFALDVLRNLLKQFAEEEEEVRYQILVLASKIFAYEMIKIKNEGGDQFKDYVEEKFSNSIEYKMFQHALHLAKYDSSYDTRDRARMFSVLLSSVDRAQLASLFLQVPKPVPFVKSDTADYLRLRAIDDYFEVCDWSDQDKLPPKSIRTEFTVQVNKLGNVSFTSSSTSREKTKSPSPVGEHSFSSQQFAQQRELLSQVEKKQTLKYKLQSLDEFFGSEDDDSSSSSSEEEEEEEEEVSEEVESDEDEDEDEDEDEEIREETNKEA

SEQ ID NO: 20699 - protein, 675 aa, Candida albicans
TMTTYEKIVKGATKVKVAAPKPKYIEPILMATSLDHSLISKENFNTIMRTLQARLHDSSWSVVYKALIVIHLMIREGDKNVTLDYLSNQASPNLLNLNNNNIIKNSNSFNSDIKFITRYAKYLHTRVKQFESTGVDYVRDERSNNNTNQQGGRLRLLDVDKGLLREVESVQKQIDSLLKNNFMENEINNDIVLTAFRLLVNDLLALFQELNEGVINILEHYFEMSKIDAERSLKIYKKFVDQTKFVIDYLRVAKHLEYATKLHVPTIKHAPTALTSSLEEYLDDPNFEINRKQYLAEKKGKDNIVLKPTQSILNKKSKNEPGQQQQQPREQQQKLQGTSSDLNRHSSLVVQQTYNPWNTMFVPIVGVVDPLQQDQAQQQAQQQAQQQAQQQALQQQVQLQQAQQQAQQQAQQQALQQRATQQATQQQQQTLFSQLPSISQGKTLQSTFTGVGFGGYGSQPQQLQAQHTNPFIQPSQQLQQPQQPLQPVGLQRFNTNPFSSMATGQHQVSQQQFAQPYSQLNMNQQPQPLQAQSTNPFANTRFASTSHTTAFTLDNGSIQPQQQQQQQNQNQKIQANATGNNPFKVSQTTLQLFDNYALTQQQNQHQQLKPQATAGGLEHLPTIPVFPETQQEAQRQFYFQNAQTGLYNQAFQPQQQQQQQQQVQQYNYHDGPSLI

SEQ ID NO: 20700 - protein, 101 aa, Candida albicans
HNHWIVNNDGLPRLMKFYTKVDIPTQKLLLQQVHLLISTRSAQECSFITPPSLLEDLDDIKVIYRHYATLYFVFIVDDQESELGILDLIQVFVECLDKCFY

SEQ ID NO: 20701 - protein, 62 aa, Candida albicans
RQVLQTVLEEIVQGGMVIDTNINRIVAAVDEANSQKNVNSNGSTISASILLSLSRDRGFWGR

SEQ ID NO: 20702 - protein, 263 aa, Candida albicans
RPSSFIEQEIDKPTTNDTEEQEAIGLDNTVEDIIDSFITSENTGTLVYENSGSGKTLLLKLVAQQLNQQHGYFTKYISCDTIMNENFQNLSKNHFFKWIQTCAWNKPSVLILDNIDKLMSVEMENMDATKSNQLTEFFISNLTKIHHQLNSNLSILLSANSKDNINKLLLGSHLIENFHHLNPPDKSLRFEILDKYLTNKLGLKIKVDLMDLVSETEGYLPNDLKILSDRIYHEVLFNSTETETETDTEATTNIDHGPGKIRA

SEQ ID NO: 20703 - protein, 93 aa, Candida albicans
  UNSURE (10): Identity of amino acid sequences at the above locations are unknown.
LYYIMTRTNXWTVHEKRPQEPKWFTHNGHSDTDPTKVKKNGAGKNNWGQPGDELDDNEVRHYQKSSGRRNSNHEMNQERLNNLNDKLDNQLMN

SEQ ID NO: 20704 - protein, 333 aa, Candida albicans
FNKEKNKTFTKDINSYPFTIRKDINFKNLALQSAGLTPRDLISIIKKSKKLAIKRLTKLSKDSQISIQNIVNIGNGGVINWVPDDFNAAINEARNQFSDSIGAPRIPNVKWEDIGGLDLVKDEILDTIDMPLKHPELFNNGLKKRSGILFYGPPGTGKTLLAKAIATNFSLNFFSVKGPELLNMYIGESEANVRRVFQRARDAKPCVIFFDELDSVAPKRGNQGDSGGVMDRIVSQLLAELDGMSSEGGDGVFVVGATNRPDLLDEALLRPGRFDKMLYLGISDTDEKQTKILEALTRKFKLDDNVNLEQVFTTGWKTPVRVEKGGEKRIYRR

SEQ ID NO: 20705 - protein, 536 aa, Candida albicans
  UNSURE (123): Identity of amino acid sequences at the above locations are unknown.
FTAIQSFKIGQVLFIVTHYPNPKRMLILHIQVDSRLAFEWDCHNCYTKFGLKIINDDVLMKLNHSKPYIRKKLILAMYKIFLQYPESLRLNFNRVIEKLDDSEIAVVSATVNVICEISKKNPXIFINYLPKFFAILEDTKNNWLIIRILKLFQSLSKVEPRMKKKILPTIIDLMLRTQASSLIYECINCIVSGQMLSADSSKDKETAKLCINQLKLFFLTNDSNLKFVGLIALINTLKIFPILINDVEGISEIVLECLNDRDLIIKRKALEVSNYLVNEDNITEVVKIMLMQLVPDNNMIDDMLKLEITLKILQIASQNNYVNIPNFRWYVAVLKDVINLTLLPVEGATNSGLIASHIANEISTEVGKEFKNLATKVPSVRSYLLQNVVLELVQDVRLLDSSALILKDLYWILGEYISELKVTQNDDGDDDSDSDSDGEDAQVMVLDIDKKIKVFNTLINYQIDKKLGLTSNIHFPVSAKLINLHFTSVVAVLIQALVKLYNGIATDYINNFATTNGQFPLEDSRLGLQRRHESPH

SEQ ID NO: 20706 - protein, 146 aa, Candida albicans
YSTLLMSSFQLQNSEVLARLKPFGILFEKSLNDLIKGIRAHTKESPESLGNFLDVAIQECRNELTTTDLETKAMAILKLAYLEMYGFDMSWCNFQILEVMSSSKFQQKRIGYLAAIQSFKNEQDLLILATNQFKKDLNSHNHGTVH

SEQ ID NO: 20707 - protein, 244 aa, Candida albicans
  UNSURE (242): Identity of amino acid sequences at the above locations are unknown.
IIINEQKLSQFIDDLINNTNFSESETIQLTSYILTLIIKLSIKFKDNQVIDTLRLILNSKTHDPNLEIQTRAVEYQQIFGQDSTLKRGLLARMPAPPVKQREALTLHKSANTTTTNTHKSLKKSTNETSGGGSGSDNLLLDLMDDIVSPASNQQQLSQQGDVISDIFGGGGGSGNDTNKSTINNAAILDLFNSSSNSINPAVSSVSEIPAFENNDVKISFIPKSFPRRAKYYNRHAVESPCXGE

SEQ ID NO: 20708 - protein, 170 aa, Candida albicans
FYGVSVLVSIFPNHSIIINCLISLVNVIVTFISATIVDKLGRKPLLLLSVSFLGIATVLMGLGIIWTSSLLSIAGTFTYITFFAIGMGPIPFLLVGEVTQPIAKALAQSWGTSMNWIATFIVGYTFPVLKEWLGGSVYFIFTVMCCVSVWFIKTKVPETKGKHSYQEVWN

SEQ ID NO: 20709 - protein, 211 aa, Candida albicans
TMAISIPSGLTLNLISSVSVICLGSLQFGYHMAELNSPELVLSCKRSQPGPVPYRDSFFGRNGFKQCIPMTPDQIGLVTSIFSIGGLFGSFYVGHLADKYGRKKTSLLHCLLYIIGSTINGLSNTYASLLLGRFICGLGAGSALVITSIYINEVSPIETKGLLGSMNQFSINIGILFTQLLSLNWSNDNDWRWLLFDRRTHCCSCQHAANR

SEQ ID NO: 20710 - protein, 504 aa, Candida albicans
TMPNPTSIHNFLDKRHSITPLLGWSTFIICLSALQFGYHLAELNAPADVLSCNVKKPGPLPSYNNTIWSHFHFNQCINMTEQGVTLITTMFTIGGLLASIILGTTSISTNYGRKHLCVVAALFYVLGSFLMSFSQTNWQINLGRLLNGFGAGSSLIVSPILINELAPLNHRGLLGSLMQSAVSIGIFIAQIVSYLYSNDQQWRLIFLVAGLIGFVQFVGLLTVPESPKWLTMAKNDVERATLILKGLRTDESTVDYEIHHWGNLTTTNLPDDETSLLLSDDSLLSRNPPLIPTKDFIMERKYRKQLIAVVLIMTGQQLVGINAITYYGVKILNELFSGSNTGNLVLMLNCVFSGINVAASIAVAPLIDRWGRKPLLMTSITMCAICTSILAIGIPNRYDIAVVTACIGFVTGWALGLGPLPFLMISEFTGHDVVATAQSLGTVMNWSPNMFIAILFPFLTNILGIGMVFWVFVINSLVYGFGFYHYVPETKGFTHYRDVWEHFS

SEQ ID NO: 20711 - protein, 355 aa, Candida albicans
IHQKHSSTMSELTELHPHHHVQIKESILVGKALLNFTTFFVTLGILVMGFEQSVYAPIITNKYFKQYYHNPSPTEIGFMIAILEIGALFSSIIAGKIGDLVGRKRATRYGAVFFYIGGFIQCISPNMFILCIGRLLGGFGIGFLTTIVPMFQSEISPAEARGFYACVEFTGNILGYAIGIWLDYAFSYLENDYSWKAPLIVQFLLGVVLWLGTFIVVETPRWLLNHDHDLEGMIVIADLYADGDVEDDHAMSEYRNIKESVLIDIFESGERSYEYLFKRYAKRLSVACFGLMFAQLNGINLISYYAPMIFEKTGWVGKQSIFMTGINGIIYVISTNPPWVLFESLGLKPLLMSGT

SEQ ID NO: 20712 - protein, 202 aa, Candida albicans
KVNVGMTVPGIILVETWGTRTLLMAGSVVMAVSQLIVAIVGVAASSHAANQCLVAFSCIFIAGFAATWGPLCWAICGESFALNVRLKSISLCTASNWLWNFGIGYATPYMVDSGKGNADLGSKVFFIWGGCNVIGGLFAYFMVYETKSLTLEQVDELYLKVDHAWQSKGFVPSVHAFRDDGDIEHISSDGKAEMVEVDENSV

SEQ ID NO: 20713 - protein, 552 aa, Candida albicans
  UNSURE (16),(24),(35),(45),(51): Identity of amino acid sequences at the above locations are unknown.
TRDKFQNPTIIHNEFXDEDEEEEXEGDDVDIFEPXQFKNSDDDDXEEGDVXSSSSLSSDINSFTDNFGNSYHNIDFDNKRYTLKLNFKGKRLVYFTSGFVSLFVSLFGYSQGVVSSLLAFDTFNKYFNQPSAATIGIVISIQEIGAMISSIMVAKLSDKFGRKRTLLLGTFIFMIGGSLQAFCPNIFILAIGRVFSGMGVGILSTIVPSYQCEISPSEERGKLVCGEFTGNITGYALSVWVGYLSYFIQDIGDSRNQPHSFTANLSWRLPLFIQVVIAFVLFLGGFFIVESPRWLLDNDMDQQGFHVLALLYDSHVESTKPKSEFFMIKNSILQERITTPKLQRTWKHLLTHYKIRVFVACSSLIFAQFNGINIISYYAPLVFEQAGFDNANALLMTGINGIIYLLSTIPTWFLVDSWGRRPILITSGIAMAICLFLVAAFMHINKSYTPSVVAVFVIIYNASFGFGFGPIPFLLLSESYPLSVRSKGASLAVSCNWFSNFVVGLMTPILKQEIKWAMYLFPASSCVLSVIVVLLFYPETKGVELEDITRNI

SEQ ID NO: 20714 - protein, 304 aa, Candida albicans
QVKFMGESLKTVTIFLLLMRVLFANAPILIIDMMRRKDVLVFGMFLTTIVIISYMILFLGFSIPIPKSEQPSLDWAMRVVFYPEKASVVLALTVFLDVVYYSMLVPTCWLYIIETFSTSSRIKGWVVIMSLHWLFEACTSLSFSFLMEELNGWLFLIISFICLGGLFFTTQLEETKGKFEFDPEFIMKESQYELSDDKTLSAQPANLKCFDESSSSNYVSSRGSKNIRDLTVPQDSNIKGKPFNSFKKSVKESNISKPIMNPWETPYGSMESFLNNEKLNQQPANASNGNVTVTKKLADAYNRL

SEQ ID NO: 20715 - protein, 404 aa, Candida albicans
LSSWISLLITVITNYTSIMPTNKPETTPGGENLLAALISCTTAAAFSATCTYPFDFIKTQQQLNNEKVMKKWNIPGNYPNSLAQLYKGGSALVLGSIVKNGTRIIAYNWLTQFMSIDSHNGNNNKTTAPRIVIAGVMSGFIETLWLIPFENVKITMIQNQTLANELKRCKNLGYDITGKVTHSPLTHHKSTKPIYLRQYVSPHAYLSSDVIDQYIKQKVRFGGVPIKDKALESLKFHYNKHPSLTLFGTVKEMYELKGLRAFTAGTFITFTRQIGISWVWLATYNATRQLIDPHNTNNEWFGHKHTMIQLVGLHFLSSMAVIMVTQPLDVIKTHLQLKNGNLLYRDSLSTAYKLFLQQGPWALFKGAFPRFLKVLISGGLTATVYEYVERLVDVAGHQKIFSQE

SEQ ID NO: 20716 - protein, 450 aa, Candida albicans
TISGNEFTSMEFFLFGIWAWTWDALDFFVTSLNVSNIAEDLDSTVKDVSWGITLVLMLRTVGALIFGAIGDTYGRKWPYIINLSCLMVIQIGTGFVTTFQQFLGLRALFGVAMGGLFGICAAEALGDAPKKARGVLSGIFQEGYAFGYLLAVVFQRAIADTTEKTWRSVFWFSAGPPIILIIWRFINPETDSYQRQKERFDQGAVQKNSKAAEFKSQAKKALNQYWLIIVYLIFLMAGFNFSSHGSQDLYPTMLTKQYHYGKDKSTVVNVCANLGALAGGIVIAHLSTFIGRRTAILIGNVIAGIMIYFWAFHPMWITAFFMQFGIQGSWSVVPIHLSELSPPHFRSFVSGVLYQLGNLVSSASSTIEATIEEQIHDYGKTMAIFIGAVLAYLMFVVFIGPENRGAELGVERDDEYSAYDSDREDRGDSDLEEGNITQKTLEKPEVEHKE

SEQ ID NO: 20717 - protein, 184 aa, Candida albicans
  UNSURE (5): Identity of amino acid sequences at the above locations are unknown.
IFVVXALCSEESSVGGIIGGIIMGQASELLGRRLTVVISIVCAGAFLYPSFFNPDRNWPAYIFLNAFVFGSFSVGPAYLLELVNSTHRTLLSGVAYQLGNLVSSASATIEAKIGERFPLKDQPGMFDYGKVMCIFCGAIFAYMIFIIFLGPERFHRDLQIHDTDEIEELQQDSSSNNESVKERV

SEQ ID NO: 20718 - protein, 215 aa, Candida albicans
GRHSNAIAHPQGVVKILLNIASILFINIKINSISHLHTHNMEEKARADHISITNSNELNYDDYSNSYKNQPELDDELFNEKPDLSLSSISRYFATRLTTLLDLPLYHTHKKWYEVINPIPGLKSMSKSDWNFYCLGFFAWALDAMDFFCVSVAAPEIANTLNISVTDVTWGVTLVLMLTSVGAVIFGIASDYFGRKWTYISIVTLFVVVEVGTGF

SEQ ID NO: 20719 - protein, 310 aa, Candida albicans
TKMASSIPGPVSLPQSKYDLTTYWGRVKHCAEISDPTMLLNTTHDIETAKRMVWDYKNGVTSKMSPELWRAKKVLDSTLHPDTGETVFLPFRMSSCVLSNLVVTAGMLTPNLGTAGTLFWQIANQSLNVAINTANANKSHPLTTKQIVTNYTLAVSASCSVALGLNSLVPRLKSLKPNTRMILGRLVPFAAVVSAGIVNVFLMRSEELKKGITVFDRKGNEIGTSKQAAWYAVGETAASRVINATPIMVIPPLILVKLQQSRFLKGKSKGVETLVNIGLIFATSLVALPSALAVFQKSRFLKTVSQIIVG

SEQ ID NO: 20720 - protein, 259 aa, Candida albicans
KECLGTTKKGGISKMSPEFGRAKEVLDFTLHPDNVGTGFLPFRSSYGVLSNLVVTAGMLTPNLGTAGTLFWQIANQSLNVAINTANANKSHPLTTKQIVTNYTLAVSASCSVALGLNSLVPRLKSLKPNTRMILGRLVPFAAVVSAGIVNVFLMRSEELKKGITVFDRKGNEVGTSKQAAWYAVGETAASRVINATPIMVIPPLILVKLQQSRFLKSKSKGVETLVNIGLIFATSLVALPFALAVFPQRRVLDCEQIRK

SEQ ID NO: 20721 - protein, 179 aa, Candida albicans
LPNTKIHYIDELALFDRLRLKSTPKHRAKDSTRRPQDTDSSACALIYTSGTTGLPKAGIMSWRKAFMASVIFGHIMKIKENSSVLTAMPLYHSTAAMLGVCPTLIVGGCVTVSQKFSATSFWTQARLCGATHIQYVGEVCRYLLNSKPHPDQDRHNVRIAYGNGLRRDIWFEFKSRFHI

SEQ ID NO: 20722 - protein, 93 aa, Candida albicans
KNLDPQRLVNTYILNNEYGVTSNDTIGVACMNKPLFIILWLALWNIGALPAFLNFNTNDKPLVHCLKIANVSQVFVDPDCDKPIIDTESQIVE

SEQ ID NO: 20723 - protein, 394 aa, Candida albicans
QPKETNLEGQLRSAHSKIVSNNEEIAFLRGHYRELDYIDYCYYTLERFSKGEYWKKAIHEIAQTFIVKYFWGAAGLVLCSAPIFIGKYFGESDDKNAAGNFITNRRLLLSASDSLDRLIYSRRYLLQIVGHASRVSDFLDTLDDVDRKKKTITANVKYNNNEITFDKVKLMTPADVTLIESLDFSIKSGDHLLIAGPNGSGKSSLFRMLGGLWPVKKGVITIPHTDNMFYLPQRAYLVEGTLREQIIYPHALDQQKKTDNELKQILQVLKLDHYFDQLDSDKNWGEELSIGAQQRLAMARLYYHKPKFAVLDECTSTVSPDMEQFMYKHAQELGITVLSVAHRTALWHFHKYLLKFDGKGGYTFDKLDEETILKLQKEGSGLTKKPENKSESTK

SEQ ID NO: 20724 - protein, 368 aa, Candida albicans
YTTFSLTVQIFFFPCAWLSHSLFISFFSLPHFLSSFQRNHSFNKIKQKKTKRGLFITLFLYEELINNIPHNLKTMSIENSKLQKNSLALSLLKVYKSNRSLLLNTSYIILLTAAFAGATNTGKTSSSSRPPNKEDSQDEKELKKKSHKLSKESFNRLARAILPSFLDKSIFYLLANLVLLVVRALLTIKVATLDGQLVGALVSKRLKLFGRYLAYWMLLGIPAAFTNALLNWTKQNLSKTIRTNLNKNIMEEYLPDSLDANYYSLMHLSGNKIKDPNQRITTDVSRLSYALASLPGQLLKPTLDLILCARQLSKSGVGYGGGNLALGLLAYFLTMIIRIFSPPFAKLAAERDQSRRSITFSTFQNCFQ

SEQ ID NO: 20725 - protein, 771 aa, Candida albicans
VSLIVEMINISRLAGYNKQDVKNILLLLHEFITTYRDNKVKLNYQSRPVILFFSTLIATAGFGLYFTFRNIITKYNEYALNKKLRRPSLIRQSSNILKNGAREIYIPKGKNKVTRIIIPKPNNDQYAADKYLYKDFVRNQRILQQQQKGVIFNSKFLNQLMIIWKILIPKFYCQNTSLLVSQCFFLIFRTWLSLLVAKLDGQIVKNLIAANGRKFSRDLIYWLLIAFPASYTNAAIKYLDLRLALGFRTNLTRYIHDMYLDKSMAYYKIGLNNSDILNIDQYITDDVTNFCQSLCSLFSSMGKPFIDLIFFSVYLRDNLGTGAIIGIFANYMVTALMLKRATPSFGKLSSQRAHLEGIYYNQHLNVMTNSEEIGFYKGSLIEKFKLNENFQKLIQHISKEINISFGYAALEDYVLKYTWSAWGYIFAGLPVFLDELWPKEAVALTGDDDDDDIAAVIAKKKKQKQQDGKDAQVDSATEGKNMRQFITNKRLLLSLADAGSRLMYSIKDVNTLTGYTDRVFNLLTQLHRVHAPKFDYGDKNGYADIQGTIQDNYPDGLRFENIRVIIPTAEGSEYAPLVDNLNFQLKHKSMLILGSNGCGKTAIARIIAGLWPLYSGLLSKPNDDDIFYLPQKAYFTTGNLRDQIIYPHTYTEMLEMGYNDDYLYHILREVKLEYLLKREKSLNTVKTWSLVLSGGERQRLSIARALFKHPKLIVLDDCTNAVSTDVEEYLYELLIKKKLTFISLSNRPSLEKYHDHVLEIEEGDWKLKTVH

SEQ ID NO: 20726 - protein, 163 aa, Candida albicans
TTLQLKFTAHGGLEALSVDWNKYKSTVIASGGTDKSVRIWDLRSITKIDQPIAQSPMASGHIRGPTPLNELIGHEFAVRRVQWSPHNPKELMSTSYDMTARIWNDELDERARFLNSRVGGLKGVFGRHKEFVIGSDYSLWGEPGWVATTGWDEMVYIWDSKRL

SEQ ID NO: 20727 - protein, 93 aa, Candida albicans
SSKTQYLVMLSFRTKGYNGYGIQYSPFYDNKLAVATAANYGLVGNGRLFILNIEPNGTVSDQISWETQDGLFDIAWSEIHENQAVVDSGDGTF

SEQ ID NO: 20728 - protein, 297 aa, Candida albicans
KLLLLLIIIFYSQKNTPDWEIFAITFFGISIPTTFVGVAGILIGNVALTYQPWGDAYKKLGMGGLLNEAFKPWGAGGKFLLMIIFLSLISNNIINTYSAAFGVQLAGTMFAKVPRWLWAILLTAIYLICALVGRNEFSTILGNFLPMIGYWVSMYFIMLLEENTIFRTDKFKYLFTKEFPRVNKEEEQEEEDGLDSSIVHHPIDARIIGTPLRQNQHYNFSIWNDYDKLTQGLAATASFIIGATGAAVGMSQAYWIGPLARRIGGEFGGDIAMWLCMGFSGLVYPPLRYLELKKFGR

SEQ ID NO: 20729 - protein, 528 aa, Candida albicans
MEIPESKNSIVSQDTISSNETDIRAPKYINWIYNLDRWGVEVRGIERVSEQERIELGQKIPTWHLFIQTLGLWWSACGGLTTMSSFFLPTLLFGLNLRDAMISGLIGMIIGCLVPAYSSTMGPKSGCRQMVTARFLFGQWGVKFVALICIVGGIGWSVVNCVLGGQMLLAINHNISLAVGIVVIAIISLIVAVFGIKVLLKFQTVFSIPIFIASILFYVVVCQKANYIGESNKLINDAGYSKVTFRGNWLSYFSLCYSVTATWGSGAADYYILYPASTPSYQIFLITFLGIAVPSTFVAIAGTICGNFALSYKPWNDAYNEFGVGGLIVGTFSHWGKFGKFVAVLLYISLICNNIMNTYSVAFEFQLVDLRLTYVPRWIWATIVTIIYLVLSVCGRNHFLTILSNFLPMLGYWITMYIALLLEENFIFRSTFKVRKLHEHEFDGDYKQMYNWTNWNNPKGRTLGLAACFAFLCGCAGAIIGMNQVYYKGPIARKVGEYGADLGMWISFGFTAITYPVFRYIELRLLKK

SEQ ID NO: 20730 - protein, 178 aa, Candida albicans
  UNSURE (167),(171): Identity of amino acid sequences at the above locations are unknown.
PPIMSKIKNNSLTIKQRPIGVTTTNYSSSIDVVTTSAPRYEDNFFNAETTHEITSETNSTSSSSTIFQYLATISKKLDSLGVETRGIERIQPYERSTNRTKQFISVMGLWLSACGGLSSMSSFYLGPLLFELGLRNTLLAGLLGEILGCFIAAYCSLMGPRSGCRQXSPLXKSNHAIY

SEQ ID NO: 20731 - protein, 301 aa, Candida albicans
MSTKREDHLRKGADVTPTEALVAGSIAGAISRAFTAPLDTIKIRLQLQPKGFKHRKSVVTIVKNLLENEGIIALWKGNVPAEILYILYGGVQFGSYSIISKLVSKLENNYRINLSSANHSLIVGIGSGIVSTLVTYPFDLLRTRLIANKNRGLLSMTGTIKDIIKLEGIRGIYAGIRPAMLSVSSTTGLMFWSYELARELSNNYQRVPFIEAICGFIAGATSKGITFPLDTLRKRCQMCSVVHGRPYTALHIFVTILKNEGVFGLYKGFGISVLKTAPTSAISLFMYEYSLSFIRKIRVIE

SEQ ID NO: 20732 - protein, 112 aa, Candida albicans
SMTQFNSDSSSTGDVPNINTSLIPSISKPVYSRIPIPGHLSNDQSTPIEDIKIIDKQSIDYIIRSGLAGGLAGSCAKTLVAPLDRIKILFQTSNPEFIKYRGTFGGFSLHHG

SEQ ID NO: 20733 - protein, 269 aa, Candida albicans
VVNMDRNKHTKGMFPTILKMYREEGWKGLFRGNLLNCIRIFPYSAVQFATFEKCKDIMLHYNPRDTQQVNGYERLIAGSVGGIVSVAVTYPLDLVRARITVQTASLSKLNKGKMVRAPKVMETLKDVYKNEGGILGLYCGIIPTTLGVAPYVAINFALYEKLREMMDSSPRDFSNPVWKLSAGAVSSFIGGVLIYPLDLLRKRYQVASMAGGELGFQYRSVAHALHSIFTTEGFFGAYKGLTANLYKIVPSMAVSWLCYDTLKDWINRW

SEQ ID NO: 20734 - protein, 192 aa, Candida albicans
HHQNLQNLYIFSRGIRWGGCSIDSLSHRYFKVQIAMLQPRSSSKCYSDSQRNVERWWSQNILSRDWCWSCWDVPLCSIGSWTFSTIKKLLVKKYGNKDDQLLPTYLTLSLGAFSGSFAATIVYPVYLLSTRLQSQGTYAHPFRYEGFYDVFSKTVAREGYSGLWKGLVPNLAKVAPAVSISYFVYESLIRRF

SEQ ID NO: 20735 - protein, 88 aa, Candida albicans
YMMRGSVDSRGEDIPAKGQHLVLNELMSRNSPSDKTHIIFSTLPAPSNGTHLNDTDSFDYTNNLAIWLDDLPPILLVNSQTVTVTTAL

SEQ ID NO: 20736 - protein, 485 aa, Candida albicans
CITSNFRSCTNFTQMFLPKTEKGKGFFKLKKHFINEKPAEKYIDLYPIQMSSVAQLDNGQSVMSTNFDTYTLILQLGYILSTVDEWEINNYRVRVIVFVEFLNEVADEKERLAGLLSSLRIDAEIRVICLENANLDSYNYMIKGYTKSQLNKTQYDKVDRVLACDQWWKNLSKARETLREIEKRKTLGKQKLRIIPTRTDSNSSLLPETFQPLNLTSRSPQGVQVQGLKNNRRYTLSNLQEQGMSLSFNLRAANLTTGKDLLYADSIVDSSDSESEDSSSVATSNTTANLGYVSSRDNSYVNLASSQATLENTQRGDLPKVKNTLKEQNVYSRTHTPEILSSRSSVINLRPNFLSVKIPTAKINDEDEDGDDQEEDEEEEGAETDNVQGKEEDETNKETAEKGSIIIKDKQSKTKDRSKQSIQFVADEPPKDLLVNPESSQSNQKGGKPKTKNLIVNDDEIIHHMETPQFLAAEDDDETDFLHMS

SEQ ID NO: 20737 - protein, 478 aa, Candida albicans
RSKTALFLFIILTISTLSIPVSTIFVKSFYPLPPPCADILYTGLSWKTFFENLYPNFTSGAAGSVLPSGQKENFTDLFGIFFPATAGIFAGASMLGELKSPSKSIPKGTIKGLFLTFVLYISVIVSMGAAIPRELLYVDIKVIQTVNISSIVIILGEFSTSLFSVIMGIVGASAMITAIADDKIIPGLSSFTTLKKSPKEKKKAQIYSIIATWSVAQVFLFADINQIATFITMAFLMTFIVTNIACFLLKVGSAPNFRPSFKYFSSKTAFAGATVCIIAMFIVDGISATLVIFCMTFLILLIHYLSPPSKFGDISQLLIYHQVRKYLLRLKLEMSVKYWRPQILLLCDNPRTSWNLIGFCNHLKKGGLYVLGHVVLMNDDTNPSCNSDKNYRTFSTATYQEVRKQKQAWIKLRDMSKIKAFVQIALGPTLPWGVRNVYLGSGLGGMKPNITVLGFYDFKKHGLALRILLSYDSNPKFI

SEQ ID NO: 20738 - protein, 510 aa, Candida albicans
IQIYTMALHQFDYLFAIAMIFAFLDAWNIGANDVANSFSSSVSSRSLKYWQAMILAAIMEFLGAVLVGSRVSDTIRNKIVDIAVFKNEPAVLMLTMTTALIGSSTWLTIATSIGMPVSTTHSIVGAVIGASIAAKGAENIIWGWKGVAQIIASWFIAPAIAGAFASIIFLISKFGVLEVKNPRTSLRNAMLLVPLLVFVAFSILTMLIVWKGSPKLKLNTLSTGTTVGAIFGTGGVATAIYFLFAYPYYKRKLVYEDWTLKWYDIFRGPIYWFKSTDNIPPIPEGQTLTKDYYKGRRYDEAGNLVVLQTDRDVSAGVVEAHDGEDSNSDGEKTSAVIQNQPAPVDSEKQPAPPAAGTAEYKGENTRWPNKFAGYVKLVKESPKNWPLVFFLLLTHGVRQDIIANQAGSKDVLAGDLHKMHTASKYYDNKIEYMYSLLQAITACTMSFAHGANDIANATGPLATVYLVWTTNTTASKAEVPVWVLCYAAGALVVALCLRPRAWQDPSLGYG

SEQ ID NO: 20739 - protein, 264 aa, Candida albicans
YDEEEEEEETHSHDSVLLNHTHFNVKQQLKITLKRKAITLFINLSELKSFIELNRIGFTKICKKFDKTCGYSIKQDFINEFLPQYSRVFENDTIEELDYKLNQIIKIYAFLSNKLTTQSTTKEDLDNIKFELRSYLRDHIVFERNTVWKDLLSLEKKSYNIDLDNSVVQNNKMGDEGHIINSMMNLSMKRINLPQCLKKLIKYDHIDIPQFLLTTQMLKIIIIVIVFIILLAVKTFNDPVQGRCLAVLVAAPMLCISQRPGRTQ

SEQ ID NO: 20740 - protein, 167 aa, Candida albicans
TGLLKVDDLNNYLWSIVMLAMGGIALGKAVTSSGLLKTIALALQKRIMHYDAIVVLIIFGALILVVATFVSHTVSALIIIPLVKEVGDSLPKPHPLMLIMGVALIASGAMGLPTSGFPNVTAIGMRDEVGKPYLTVNLFITRGVPASIIVYVCIITIGYGIMSSLNF

SEQ ID NO: 20741 - protein, 322 aa, Candida albicans
  UNSURE (49),(81): Identity of amino acid sequences at the above locations are unknown.
RKDFGGRTLIILKRDFEDFFGINLEPNKIFSRCLLNKFGGVLGSSTGYXHYQPHRILTGNSINQEDDDDDDDEEDALTSAXQETRGRGRGGSVPELHENAHQLRHTRSIDDYATNSPKFWNDLNNATCSNNVPPQLLLLSENRIILRKRVIGLYTTLSELKSFIELNYTGFKKALKKFDKSLNTNIKDNYLENLPNNSYIFKKSTMKKVDEHLDSLVKLYALICNHGDDLEAAKQELSIHLREHVVWERNTVWRDMIGLERKSYAANSKLMNRSDGNNDEKEDGSGNMKLMLKFNISLKNPVVIKLILIFAVTVFYIECISI

SEQ ID NO: 20742 - protein, 82 aa, Candida albicans
TSQYPTTTTTTTTTTATATTVKMKFSHSLKFNAVPEWQDNYINYPTLKKTIYKLQQDQLVHNGNQDQGFIVGTNQTTVSQLV

SEQ ID NO: 20743 - protein, 319 aa, Candida albicans
  UNSURE (300): Identity of amino acid sequences at the above locations are unknown.
NSTTTLHIGMKFAESLKEGLVPEWQDQYVDYKEGKKLIKKCKKLQEEYAFEDTLKFQKKDINNTTDDRTPLIVHTEPQQVYTTGAIDENNENEVEGIPPLSASQYSNSGYSRRRLSIFATSVRSSSKKDDYIKEKANFTKWLNEQLMKVDDFYIEKEQDVYERFLLLQDQLYQLRDQKTQLIKEKNIHDNKNHPVKSNTDHVVNKVNDFAFHTKSIISNLNRFELPSLPSLRFLKKWKTKNKRDNQFQDEISLQIQDKADLNYAENRVRNGIVDITEGATIDLTSLEESDGESIFIPNVXAPQPPPPQTEELLRQREPT

SEQ ID NO: 20744 - protein, 242 aa, Candida albicans
KEKKDFIFPFFTGFPLFANVFASLGFLAYIVGEDMGIITSKFYAQKYCDYIFGFDIKSYSQNETGKDKKLTRKSLDTQLIVYRDSPIAICSLVVDETQSSAANFIVKITGIHVRKVFQKVNFDEVLIDWAVVRARELYQEFLTSKNIKTPPENSSILITIDAYSFDNAFEKTLYNHGFRILDSSFELNPFSPAVSWYKERLYRFLNVSRDTFGLMLTIAKDDIESINSDTKQNNQSKIKKRH

SEQ ID NO: 20745 - protein, 72 aa, Candida albicans
KAISSIIMVVQKEIDLNKPLDANAAPVLAKTTLKPELSKAAIVLHGDRYKQLQAKLTKYVLSLNRAEMEGHA

SEQ ID NO: 20746 - protein, 828 aa, Candida albicans
YIMTGVLEVVKSITSNEGFVSEVPHLYGGEEHHKVKSHEFDSNSINNTNYNSNVFVPAYDEREVTVKEWFQYIFANPLKMIADYLISLFPILKWILHYNIRWLYGDLVAGITVGVVLVPQSMSYAQLAGLEAQYGLYSSFVGVFIYSFFATSKDVSIGPVAVMSLQVSKVIAHVQDKFGDKYAAPEIATFLSLICGGIALGIGLLRLGFILEFISIPAVMGFMTGSAFNIITGQVPGLMGYNSKVNTRDSTYLVVVNTLKHLPDSTVDAAFGLIPLFILYLWKFLTDYAQKRYPRHKMYFFYFQQLRNAIVIIVATAISWGIVHPKKVAFNGPSSKFKPPIKTIGDVPSGLRHVGVMSIPDGIISAMASEIPVSTVILLFEHIAISKSFGRINDYKVVPDQEVIAIGVNNLIGTFFNAYPATGSFSRSALKAKCGVRTPLAGIFTGAVVLLALYALTKAFYYIPKATLSAVIIHAVSDLIANYKITWSFWKMSPIDCGIFLIAVILTVFVTIEAGIYFAIAASVVVLLVRVAIPHGQFLGKIQIAEVVNPIIEQTGSHDEHNASASDGTSYSSDLEIHQVLSEGTNYKSTDEAGKLKAKEDIKPVEGVTTSALQRNNPQVKFHTRWVPLNNENINAGIKVQPPPPGVLVFKPVETFTYPNASRQVDKVSDEAKRLTRRGKPFDYSKIGSRPWNDPGPLRWNLPWSKKEKVEEKVEDNRPILRIVHFDFSTVASIDVTAIQALVDLRKALNAYADREVEFHFSGILSPWIRRGLLNAGFGTYEDGLLSTNNYVNIAAGYKDLEDHVDEPYYAATGTNTPFFHLDIPNYS

SEQ ID NO: 20747 - protein, 254 aa, Candida albicans
  UNSURE (178): Identity of amino acid sequences at the above locations are unknown.
RPLLEHYRALSLLKSFKTMNRTAFRKITKKYDKALKTELMQPFMHKIDTTSYFLTSDLLDKLINHVEELYIVFFDSASTDRKHSLEKLKTIAYAINASEMRPPSFYKEFFVSGLFLGFGLPLFVLALYTVLDKTLNIDMTEGKYLLQIWAGFFLLNLTFILFAVNMAVFDKFKINYRXIFEFNIATTLNYKQFLVLPSFGFAFFTILAWFSFNNYWPSDFPWKGLAMDLFCCHVNNFFLTGGIYFTVIVEDGYK

SEQ ID NO: 20748 - protein, 88 aa, Candida albicans
HYYPLLGSTMKFSHSLQFNAVPEWSSKYIAYTTLKKLIYSLQRDNLRRTYQQDDEEATLEGSHLIGANYASTVQTQDESASAVSIAAL

SEQ ID NO: 20749 - protein, 421 aa, Candida albicans
EAIPLFVTSLVIPLLIVVLNVVKNDDGSIMETVDASKFILSTMWNSVILLLLGGFTLAAALSKYHIAKLISTWILSKAGTNPAVVLLTIMGVALFASMWISNVAAPVLCFSLIQPLIRTLPKGSRFINALIMGIALASNVGGMASPIASPQNMIAIGAMEPQPSWGEWFVVALPVCVLALLLIWVFLLITFNCNSRNTHLVAIRTIDDKFTGIQWYIIIVSFGTILLWCLASRLTGIFGEMGIIALIPVILFFGSGLLTTEDFNNYPWNIVILAMGGTALGKAVASSGLLNTIAVTIQSQIEGFSLFGIILTIGIFVLTIATFISHTVSALILIPLVSELGHNMPDPHPRMLILSTALLCSAAMGLPTSGFPNVTAICMTDEFGKPYLTVGTFIKIGVPASVIAYVIIVTVGHATMKIINF

SEQ ID NO: 20750 - protein, 139 aa, Candida albicans
SIHIMSAEEVIQYISRRKLFTENNEYNESYLLLFTIASSMIWIMIPGLAFLYSGLARRKSALSMIWIVIMSSFVGIFQWYFWGYSLAFSDTSKNSFIGDLHFFGFKNLLGASDDKTTYPDIAYSLFQLQFLVRDFRNYR

SEQ ID NO: 20751 - protein, 175 aa, Candida albicans
NYRPHNISTIFLGTSLLYVGWLFFNGFSCGNPSLKVAYSMMNTHLCGAFGAISWCLLDFRLENKWSMVAVCSGCISGLVAATPSSGMIPLWASVILGITAGIVCNLSTKIKYLLHVDDSLDVWAEHGMAGVVGLIFNALFGSATVIGYDGVTDHQGGWIDHNWTQLHIQIVSTTA

SEQ ID NO: 20752 - protein, 225 aa, Candida albicans
IFSIGNVIKVKVDGDKLGYLQLEGISMAKLFFQDLLTYWILFSNLVPISLFVTVELIKYYQAFMIGSDLDMYYEETDTPTGVRTSSLVEELGQIDYIFSDKTGTLTRNVMEFKSCSIGGRCYIEEIPEDGHAQVIDGIEIGYHTFDQLHADLKNTSTQQSAIINEFLTLLSTCHTVIPEVTEEKINYQAASPDEGALVQGAADLGYKFTIRRPKGLHHGAGRIRA

SEQ ID NO: 20753 - protein, 324 aa, Candida albicans
LEKDLFLLVPTVFEDKLPDGVPDTIHTLHQAGIKIWVLTGDRQETAINIGMSCKLLSEDMNLLIINEQTKNDTRLNLQEKLTAIQEHQFDAEDGSLESSLALIIDGHSLGYALEPDLEDLLIELGSRCRAVICCRVSPLQKALVVKMVKRKKKTSLLLAIGDGANDVSMIQAAHVGVGISGMEGMQAARSADVSIGQFKFLKKLLLVHGAWSYQRLSNAILYSFYKNIALYMTQFWFVFTNGFSGQSIAESWTLTFYNVLFTSLPPFVLGVFDQFVSARLLDRYPQLYQLGQKRKFFNVAIFWTWILNGFYHSAVIFLVFIFHL

SEQ ID NO: 20754 - protein, 451 aa, Candida albicans
FFVVVFLLKAVLFNKTLTMSNYNRTDNSKSNANPNPNANPNNPFSDNANNLIDLDIESNPYGDFNPNHVYPQTQRNTTTNTTTTTTTPHDPFADQFVLTDDSDEDNDDDDDVDGHNAHNTSFASSSQNRQVPLLNTANIPKSPTNRFFNTHNTNNNEYINMTDKQETSRDFDITHIFRKLKSKITGKPANLGLNDRQQSHQQQQPREINIMNHSANAGFGYYGNHISTTKYNIATFLPKFLFEQFSKYANLFFLVTSIIQQVPHVSPTNRYTTIGTLIVVLVVAAIKEMFEDIKRANADKELNRTKVLVLDPVTGNFTLKKWIKVQVGDVVQVLNEEPFPADLILLSSSEPEGLCYIETANLDGETNLKIKQAIPETAHLVNPRDLVKDLNNAQILSEQPNSSLYTYEGNLKNFRRGPDIPLSPEQMLLRGATLRNTQWILHQADGPTTLG

SEQ ID NO: 20755 - protein, 129 aa, Candida albicans
  UNSURE (2): Identity of amino acid sequences at the above locations are unknown.
RXSFQPGGEDDEYRGVLRMTYPLITFWGMVFGVAILCLLRDFAWKYFKRRYNPESYHYVQEIQKYNIQDYRPRMEQFQKAIRKVRQVQRIKKQRGFAFSQVEGQDQDKIVRLYDTTKKRGVFGELSESK

SEQ ID NO: 20756 - protein, 228 aa, Candida albicans
GSKKKTRMSSLTIYAAKILLKRAISGDLEEDTPDLTTPDDAEDSNPVENEIFSSWALFILLFLLMSALWSSYFLQQRRIKAVHETVLSIFCGMIVGLIIRMSPGHYIQDAVKFNPGYFFNILLPPIILNSGYELHQANFFRNLGSILTFAIPGTFISALVVGIILYIWTALGLDNVSLEFVDALAVGATLSATDPVTILSIFNAYKVDPKLYTIICVHQQAKKVHCRG

SEQ ID NO: 20757 - protein, 315 aa, Candida albicans
PDVNTWREALFCGHFGPIGVGAIFASILARKDLEAHYTTEETPLHHLPNEDFPHYQLLATIWPIVCFIVITSIIVHGSSVAVLTLGKRLNRMAITMSFTTDQEGNGSGGWMQRLQKLDRATTSFSLHRVDTMAPTEKLQPETTGTKVRPTGGAKRKKNHRDDRTPPEAQILQLGGNKTPEPESASDTLAIPNKTSGLSAFGEKPPTKAEKAPVPTVAYQDGDQVIIEDQYGEVMENLKLTTKPVRAPDIGSIHSMESLERHLTQYSTGSGEYTTDEDTHGLQEKLSRSLSRRSYYKKDDPNKRQVYAHRVGEFEW

SEQ ID NO: 20758 - protein, 412 aa, Candida albicans
  UNSURE (396): Identity of amino acid sequences at the above locations are unknown.
QISVLFTDSLSDSTNNMARTCCPISGDTISWRNVTFFHYKKKKRTTKIFFFLINSSSPHFAMAWSQLELEPPHIAYACVGIFSTLFSLVSLFVKERLYIGEATVASIAGLILGPHCLNWFDPVSWGNSDYITLEICRIVLCIQIVAVAVELPKKYMMKHWLSVTIFLLPVMTCGWLIVGLFIWCLIPHFTFNDGLLVSACVTATDPVLAAAVVGKGKFAERVPGHLRNLLSAESGCNDGMAFPFIFLSLNLIIHSGHAGEIVKDWFLLTILWECIFGCLLGTVIGYVLRKLVAFAENQNLIDRESFLAIFVFIAFISAGIGSMLGVDDLLVSFAARTAFGWNGAFAKKTEESHVSTVIDLLLNLSFFVYFGAIIPWPQFNNADLGLNVWRLVVLAXVIIFLRRIPPLSPSNQ

SEQ ID NO: 20759 - protein, 477 aa, Candida albicans
  UNSURE (15): Identity of amino acid sequences at the above locations are unknown.
RRLGIECMETCRVGXCHHILEKNPAVVALKPITPDVKTWREALFCGHFGPIGVGAIFASILARKDLEAHYTTEETPVHHLPNEDFPHYQLLATIWPIVCFIVITSIIVHGSSVAVLTLGKRLNRMAITMSFTTDQEGNGSGGWMQRLQKLDRTTTSFSLHRVDTMAPTEKLQPETTGIKVRPAGGAKRKKNHKDDRTPPEAQILQLGGNKTPEPESASPSDTLAIPNKTSGLSAFGEKPPTKAEKASVPTVAYQDGDQVIIEDQYGEVMENLKLTTKPVRAPDIGSIHSMESLERHLTQYSTGSGEYTTDEDTHGLQEKLSRSLSRRSYYKKDDPNKRKVYAHRVDDLIVIENEDGDIIRRYKVNKHAPAPRARSGSIMGMVKSMVGIKPPPEISVTDLEHGTQHKIILPEEENTPMSSKTEQKLEDTIANILQENHTQPISEESADEEETEVEKKRRLQALGYLPSSRRDREDEEE

SEQ ID NO: 20760 - protein, 550 aa, Candida albicans
RRICVKKCPFDAITIINLPTNLEGETTHRYSANSFKLHRLPTPRPGQVLGLVGTNGIGKSTALKILAGKQKPNLGRYDDPPDWEEILRHFRGSELQNYFTKVLEDNIKAIIKPQYVDNIPRALAKSKVKQVGAILESKNEKNDDYNYILNVLELKNVLNREVENLSGGELQRFALGMTCVQDANVYMFDELSSYLDVKQRLRAAEIIRSLLNPTTYIICVEHDLSVLDYLSDFVCILYGAPSVYGVVTLPASVREGINIFLDGHIPTENLRFRTESLQFRLADAADDLILDKSNSLEYPSLQKTQGDFKLRVEAGDFTNSEILVMMGENGTGKTTFCKLLAGAIAPDGGQEIPKLNVSMKPQKIAPKFTGTVRQLFFKKIRAAFLHPQFQTDVVKPLKIEDIVDQEVQTLSGGELQRVAIVLALGIPADIYLIDEPSAYLDSEQRIICSKVIRRFILHAKKTAFIVEHDFIMATYLADRVIVFEGQPSKDAVARSPESLLTGCNRFLKNLNVTFRRDPNSYRPRINKLDSQMDKEQKASGNYFFLENTEL

SEQ ID NO: 20761 - protein, 209 aa, Candida albicans
MVIYTGFVIPKPSMLGWAKWITYINPVSYIFESIMVNEFYDRQFECSQYIPSGPGYENVDSKNKVCTAVGSVPGEPFVNGTNYLKYAYEYYNSHKWRNLGIAIAFAVVFLGVYIWLTEYNKGAMQKGEIVLFLKSGLKKHKRKNQKATGTALEDIETGKFSNDKLIYPSDIEEEEGGATDKRLNLSGTDNRPEIFFWNFHHGLDDPRLH

SEQ ID NO: 20762 - protein, 611 aa, Candida albicans
  UNSURE (592),(595): Identity of amino acid sequences at the above locations are unknown.
HVWEFAAKMRTPQNRPLGVSRDAYARHLAAVVMAVYGLSHTRNTKVGNDFIRGVSGGERKRVSIAEITLNNAMVQCWDNSTRGLDSATALEFIRALKASADIVHTTPLVAIYQCSQDAYDLFDKVVLMYQGYQIYFGSAKKAKQYFIDMGYECPQRQTTADFLTSLTNPAERIVRQGFEGKVPQTPQEFYEYWKKSPEGQQIVADVDQYLTEHSSAAEKEAIKEAHQARQSDHLKPASPYTVSFFMQVRYIAHRNILRIKGNPSIHLFQIFGNIGMSFILSSIFYNLPTATSSFYHRTAALFFAVLFNAFSCLLEIFSLYEARSIVEKHKKYALYHPAADAFASIVTELPTKFIIAIGFNLVYYFMVNFRRTPGNFFFYLLINFSATLAMSHIFRTIGAATKTLQEAMTPAAILLLALTIFTGFVIPTPNMHGWCRWINYLDPLAYAFESLIANEFHNRDFECSQYVPSGGSYPTAGPNRICTPVGSVPGQDFVDGTRYMEMSFDYRNLHKWRNFGIVIGFIVFFFCTYILLCEINKGAMQKGEILLFQQRALKKRKKANNDIESGELEKVTQSLTPSLRINKNNGTIWREXPSXGENWTFPVEIQSGRMN

SEQ ID NO: 20763 - protein, 267 aa, Candida albicans
LISFLAMADADTSSNSSKTNEDRSQEGFGTYQGYTDRVALEVQELARIISHASIQQLKLKRQHSRQESQKSNEQESELSGKLGVIPVDENGNFVDQRLNPNSPEFNAAYWIQNAHKLVSSDIDYFKPVTIGVAYKNLRAYGSASDADYQSTLVNLIPKYLSLFFREYILRHTGPTFDILKPMDGLIKPGELTVVLGRPGAGCSTFLKTIASQTYGYHIDKDSVIRYNSLTPHEIKKHYRGEVVYCAETENHFPQLTVRDTFGNLLQK

SEQ ID NO: 20764 - protein, 613 aa, Candida albicans
QQLIMSISASKAKREQKRLEREAKKAAVGKSTKKTKKQAEKDAAEDEVEGAEEQIAKMKLQTDEHGLSDRVTTGVLESLETSRDIKLSSVSLLFHGKVLIQDSTLELNYGRRYGLLGENGCGKSTLMKSIAAREFPIPEHIDIYLLNEPAEATEYSALEYVVREAEHEMKRLEDLVEELIVKEGPECPALEGLYEKIDEMDPSTFESRAAIILTGLGFNSVTIKKKTKDMSGGWRMRVALAKALFVKPTLLLLDDPTAHLDLAACVWLEEYLKRFDRILILVSHSQDFLNGVCTNMIDMRLKLLTTYGGNYDSYVKTRAELETNQMKQYNKQQEEIAHIKKFIASAGTYANLVRQAKSRQKILDKMEADGLIQPVVPDKVFTFRFPEVEKLPPPVLAFDDMSFSYSGKPEDNLYEHLDIGIDMDSRVALVGPNGVGKSTLLKLFQGKLQPQTGRVIQHTHIKLGVYSQHSADQLDLTKSPLEFVRDKFANISQDYQYWRGQLGRYGLSGEAQTAQMATLSEGQRSRVVFALLALEGPNLILLDEPTNGLDLGTIDSLADAINAFNGGVVVVSHDFRLLDKVAKDIFVIENKTATRWNGSILDYKKSLASKVVL

SEQ ID NO: 20765 - protein, 280 aa, Candida albicans
  UNSURE (252): Identity of amino acid sequences at the above locations are unknown.
IPIDYTLAFEVKNLTYEFPNSKKIGLQDFNLAIPWGTTNLVVGPNGAGKSTLLRILAGKTLIKKGHLRLGGFDPFHFSSQRHEQANSDINNYITYLGTEWATNSIIKRDIPVNLLLASIGGETYQDRRNLLIDILDIDPSWSMLNISDGERRRVQIAMGLVKPWKLLLLDEVTIDLDVVVRLKLLNYLKQECQERNCTVVYATHIFDGLGHKWCDRVIHIDAGLKLNDVKIKDIEFVNDDGRVEVGDEKIIXSKAESLHPLALFWLNKDLKRRRPEMTKN

SEQ ID NO: 20766 - protein, 274 aa, Candida albicans
PNGAGKSTLLRILAGKTLIKKGHLKLGGFDPFHFSSQRHEQANSDINNYITYLGTEWATNSIIKRDIPVNLLLASIGGETYQDRRNLLIDILDIDPSWSMLNISDGERRRVQIAMGLVKPWKLLLLDEVTIDLDVVVRLKLLNYLKQECQERNCTVVYATHIFDGLGHKWCDRVIHIDAGLKLNDVKIKDIEFVNDDGRVEVGDEKIIVSKAESLHPLALFWLNKDLERRGTRDDEKLKMSKRHNDYVNSRDGKYFDADDSKLAQYFKSTRSSK

SEQ ID NO: 20767 - protein, 91 aa, Candida albicans
DETTSSIDYKTDYIFQRSVREHFNNLDILTIAHRLRIFMDYDKMLFLDAGKVVEYDNPYVLITHTDSLFYSMWENSGELESLIKLAKEAYM

SEQ ID NO: 20768 - protein, 111 aa, Candida albicans
FKLYAIDSGQKQRVSLARTLIRDPKILILDEATSALDSVSEEIVMLNLIQLNKNRGVTLISIAHRLSTIKNSDRIIVFNQDGQIVEDGKFNELHNDPNSQFNKLLKSHSLE

SEQ ID NO: 20769 - protein, 167 aa, Candida albicans
APPYDDPRPAVKMDELNGDIEFKGIDFTYPSRPESGIFKDLNLHIKQGENVCLVGPSGSGKSTVSQLLLRFYDPEKGTIQIGDDVITDLNLNHYRSKLGYVQQEPLLFSGTIKENILFGKEDATDEEINNALNLSYASNFVRHLPDGLNTKNGASNPTQLSGGQKQR

SEQ ID NO: 20770 - protein, 300 aa, Candida albicans
LQISQLNKMLVETYSWSNISLTLQNGKTILDDIYGSVSAGEMLAIMGPSGCGKSTLLNVLAYRTSPRSSTLEGGIFINNERATLNKIKQLSSYVEQEDSLIGSLTVLETVDYSAQFAGIDKAHKKELVSKTIKSLGLEGQAMLKIGTPIQKGISGGQKRRVSIASQIITSPSILFLDEPTSGLDSVASREVISTIKKIAKRENMVIICSIHQPSTYTFELFDKVMFLSKGRTVYNGAVSNVVKYFNSIGHTMPPYINPAEYVLDLINTDFQGDSSVLDDLVSKWNSGDVHNVYSPRGWKE

SEQ ID NO: 20771 - protein, 286 aa, Candida albicans
RFINVGIVIIGVTVGWMFYRPKHDLAGIRSLTSTLYVAMEIMGFVPMYFEIARLWETDGVFFYREYLENQVSIPGFLISRRLGKLFLEDLPMSLLFSIITFFMWGLRLGDGSHFGIYFVVVFLIELCCMGTAMFSFAIAPSYPISALLINLIYQIQNSACGYFVNAATMPVYVKWTKYLAYFWYAFGALTNNQFSGWHGKCPYNDINDPRCQEFSGDYQIKILGFPVGWVGAPIGYLVLWTVGCFVLSGILFYFKQHDVCMAKTKKNTIGESDEDHEALHQKKTER

SEQ ID NO: 20772 - protein, 518 aa, Candida albicans
MVIQGYCGIRLSEFSAYGIQHDSFLIEQLTVRETLYYQAKLRLPLDQHKFIPTIINKLIRQTGLVDCADTLIGSEYVKGISGGEKRRVSIAIQLLSKPKVLFLDEPTSGLDSSTAETILTLLGELAKENNTTIILTIHQPSEQLFYKFGSLLLLGRGGKVIYDGTSVGIVEYLESLGYNNPEGHNIADYILDLISRGMNEDKMQLERRVAELISYWQANSIKKLCSTATFLQEIIDLPQYYYQRLPIFITFPTIFRRQLLTSYRAKDVVINRAGQTIFLAIVHTLYFTPLRNTQEGISNRLGLVQEVLNLYFAGLINNITLYPFERNLFYQEYRDGIYGVTEFGLSYLINELPTEVIPCFFFAALIVFACGLPRTPQMFFAMFGTGFVSINCGESLGIFVNSIFTHMGVATNVLSTFVSLAIFMGGTMSLHMPGFFKGINFISPMKYAVAICANLGFKNQSFKCNSEAADCLLTTGEDVLSYYNMKQNLGPMVGGLIGCLVIYRVVAILSIYVRVKWF

SEQ ID NO: 20773 - protein, 744 aa, Candida albicans
MIILPSVRNLLFLSSRKSIKVLPARQYLQNLTFTSTRLNLIHSTPSSYLLKTACLSQFRTYATTPLYNLPPSQVLVKSHLDATNLKKKEIKQERFEEFQKQENKKTFKQNLRTIGRIIKLGKPDWKLFVLAIGFILCAVLYPTTAVKLVGSVLDSFNNNIKDEDGDLIVWGYKVSTVFAVMIPFMAVSAVCFWARIWVLKLLGERLVARLRARVMKNLLRHDQEFFDNDKHKVGDLISRLSSDAYIVSRSITSNLPDGLKNLLFGLLSSYMMYLINPMLFGMMLLISPPITIGSVFYGEKIRKLSTNLQNATAGLTKVSEETLNSIKLINAFTGEQKELRKYSTRLRRVVDVAKQEAFAQSNYSVSIYSLYHTGYLACVALGVYLMTKGTMSAGDVVAFTMYLEFFNSALYSLTTTYLELMKGAGAGVKLFALIDYKNKVPAIQGEKVTTWRPTSVKDDIQFNDVTFSYPTRPNHTICDHCNFKIVGGTSTCIVAPSGAGNSTVASLLLRAYDIQLGEILIGGKNIKDIQVRDLRRYIVGIVQQEPVLLSGTILENIVYGLTSSEINKLTMQDIIDVSKQANCHDFIVTFPDGYDTIIGNRGASLSGGQKQRIAIARALIKRPKVLILDEATSALDSKSESLINETLKNLTNEGSMTIISIAHRLSTISKSEFVVVLGKYGQVVETGKFVELFSNPDSELSKLLDESATSQAAADRQEEEEELQQENRHKTQEDEREHIKCLNT

SEQ ID NO: 20774 - protein, 425 aa, Candida albicans
LNNLIQKLSSSSSEETNKKSFSSDKDNILEPFVSEEGTSLVDQQHHHQQGNTDTTTTMETTPHSTSRIPSLNEDTRLSSSSELMPIQSSSSATAPSSNRSEQRDLEDLELQTPPRLTTKQRIQRVLHHFFPVRQTYERINNGLTTGRMQTNNGRFIGQGTDGVFRNLMAKPDTEEMRQQQELNPPSYEEAAADASPEYWELTMISPMYEDEVFVQGLPVGNIANFVWNALVSVAFQFVGFILCYLLHTSHAAKQGSRAGLGINLIMYGWNLVPQNFGHPDKLPKKYQPENPNDFDINKSTKISGKVDGYNSGIFIQNSNADTKDSNGGDWLGGSGSAPYVAYGLIAFGLFIILKSLVDYYRVKQLERAILNPPSNMPVNTNSITGVVDEIDEENRHREQQQQQQQHQHQEEEEPYSHQHRNHDDH

SEQ ID NO: 20775 - protein, 140 aa, Candida albicans
IPFDNVFYEVSPIHKDNVITDLHNRLGGNQSSSVNVAFIGDGINDAPALAKADIGMAISSGTDIAIESADIVLIGGRINQTDLHGVVNALQISTDTFNRIKINFLWAIIYNIFMLPFAHGLLFTIEYCFTTSCSWCCHDV

SEQ ID NO: 20776 - protein, 959 aa, Candida albicans
KMKSLAILESNPNQNNNVTVVLEVLDLHTAKDITDVINILDELFPKLKSKDFDHQELTLIYDSNDYDDMSILNAISEIGFPVKILSSTAPQCKTTVNIQGMTCGACSASITEALEKTPGVYKASISLVTENGLIMHSPKLSPENIITIIEDCGFDAQIESSKTKQSLAPESLQDQLKRLNTTIGIIGMTCGACSASITNVLEKLPGVENVSVSLITEEASIVHDSTITTVQQLKEAIEDCGFTPTFNKSINLNQYQNTNDSNEEVTLKIVGVNHTTDLIGLRYNIEAYLRSISGVQKFELTLRGMNASSNIMPTQVGTLITEEDTIADVKSLVNELVFQYDSDSVGIRDIIDGLNTISDNIEFMVINSLDQSSATQLKLLSKVKDINYWKKIFIQSLLFGIPVLFLNHTKNWPIWKTTMIFPGLYLVSLLELILSTYIQFYLGSVFIKKFSSFLRKKFKGATMDVLVCISTMCSYIFSLTTIIVSVWNGQKNGPPPVLFDTLVMLISFVSFGKLLENKAKGATSTALSSLLSLTPSTCTIINDIPGYQKFIEDQQSLEKSEKSNLLSMQEFPTRVISIDLVQPNDIAIVLPGGKVPADGEIVFGETEIDESLITGEPLPVYKKLKDKVIGGSINGPHLIHIKVTHTGKKSQLQQIINLVKESQVNKAPVQKFSDYIAARFVPFVLLLAIFTFILWMIICFTIHQDKLPKIFQNETNGKFFVCLKLSISVIVVACPCALGLAAPTAVMVGTGVGAINGVLIKGAKVLEKITGVNIILFDKTGTLTTGEMSLVNFQPIMSKSSITISDWWKLVGSVECHSEHPIGRALTKLAKTNLNLNFDDDHFDTTVNDINVLIGLGIQANVTLANNPQTQFNVYVGNDKLIESKFPNLLNNIDEKLLHSANTVSHVIIDGEYSGYIELTDALKSGSWEVVNYLKTQGYIVGMVTGDNRGAALKIAQEV

SEQ ID NO: 20777 - protein, 637 aa, Candida albicans
VRIMQKFIINFANIHCDKCEGIIRNVVSRYYKISDETDLNANIKPSEVIFKLENNEVTLYGNDLIDFHGDIKSIIKSLGKSGFDILSWDLHNGDETVSSSQIVNTNIQGANEPDGFIDIVGMYHKFINSRNKKKHMKYCKVCQESEQHKKKSTDSDFSSSSEDTVVEIPHQEFRASFLVTGMTCASCAQSITDNLRSILGESKKEDEPNFSVNVIQQSVVVIIPNKQIINKIVDAINDMGFDCKLIEVLPVQRSVNTKVTALIGGMTCAACANSIDSAVKELPFILESGINVVTKAAQFVLEDDGGLNIAKLKETIEDCGFDFELLSTEKVNYTSGKQKPRSINLKVNGMFCNHCPDIITQYLTNYGDAVVINDPISLDHPVIKFTYVPLQTLKTRKILFDLNHLKDDGNGGYTITPDEKGAFECEIIKPVTVDEHVRKLAHREVLGLAIRLAIATLFAIPTFIFGIVAMSLLPKHHPFRVWVEDPLWVGNVSRNSWILFIFATLVYFFAADTFHRKAIKEIKSLWFHKNSFKSRLLKFGSMNLLMSLGTTVAYFASIVLIGLSATQKPMTHHGLHTTYFDSVVFLSFFLLIGKLLQSYSKSKTADAISELSKLKQTEATLIEDNKDTRVDIQLLEI

SEQ ID NO: 20778 - protein, 122 aa, Candida albicans
RGRRHQFFEGLALSSRIISITNASLSTKLVMALMFALITPIGMAIGIGVLNKFNGNDPSTLIALGTLDSFSAGVLLWTGLIEMWSHDWLHGHLRNSSFVKTTVALVSLILGMLLMSLLGNWA

SEQ ID NO: 20779 - protein, 128 aa, Candida albicans
RYIVLVFHQMFEGLGLGTRIATTNWARHRYTPWILAICYTLCTPIAIAVGLGVRKSYPPGSRRALITNGVFDSISAGILLYTGIVELMAHEFLYSGEFKGPGGFKNMLLAYFVMCWGAGLMALLGKWA

SEQ ID NO: 20780 - protein, 345 aa, Candida albicans
TLNMVNHKNSGGLATKDNVSITQDEISHDEISQSDTPYIDISLDIDEEEVQRRNNSKWFQVKKFWWDGTGKHPKEQQYLMKLDFFLLTSSCLGYFIKNLNQTNVTTAFVNGMDEYYGMNKNQYNYLLTMFTIGYIIGQIPSNMLLHKISIRYYLGGLEIFWAFLTLIMITVPSHKIKALYALRFLSGFTESAYFPCLEYILGAHYSKDEVSKRSAWFAISGNLSGIVSGPLQQAIIKRFSKSGMPPFKWMFVFDAVISFPIGIYTVFANPNTPSTTNLWYFTEDDKKVGLERRRLIGAEINTKTNYSWKKVKSFFNTWHIYVFPIVFLCYNNSCAALGQLLVIDT

SEQ ID NO: 20781 - protein, 82 aa, Candida albicans
LYGLFSCWNNSNASSGAYALWLKSLTDSDGNQRFTGGKLQDYTALTPGLGLIWLILASTFADLFRSRWVYFIYLPHAWKSQS

SEQ ID NO: 20782 - protein, 430 aa, Candida albicans
RRYFYPKIYLINSLDIPHKSFKNFLHFFVNKQIIKTSPNTIMSFFSEPISRLKWGIFPTRRIVDEDEHGNFIDPDTIMANSSLAPSSDNDDDVASISKTNLEKLKTKEEIKFISSTPKATPVVLEYRDEKNRPWWKFFDEYEYRVTSNVKSKRKWYKWFHEDDTPEERRVIMKIDILLTLYSLAAYFVKYLDQLNLTNAYVGGLKEGLGMKGNDFVNTGVMFSVGNIIFQIPFMYIVYALPLNYVLPALELGWSVLTVCLYRSGNVHGLKALRFFIGAFEAPAYLAYHALFASWFKASTGEIARRAGFYYLGQYLGILTSGLLSGTIVRHLDGAAGHAAWQWIFIIDGIISVVIAIFGFYMIPGTPQDCYSIFLSDEEIRIARRRMKADQKDSKPRENAVKYFFNKDIWKKIFTSWHFYVLTLWTIFLLE

SEQ ID NO: 20783 - protein, 286 aa, Candida albicans
FRGHHKIVIVFFLSDEDIRMARRRMKADAKDSKPRENAVKYLFNKDIWKKMFSSWHLYVLSLWNMFCWNNSNAGSGAYALWLRTLKDSAGNLRFTGGKLQDYTALTPGLGLIWLILASTFADLLGSRWGAILFTQVFNILGNVLLAVWHIPERAKWFAWCMQYFGWAMAPVLYSWQGDICRRDIRERQVVLVSMNILAQQSTAWIAVLVWKTVEAPRFLKGYTFTACSAFALSVWTMVVLWLYKREERENARANGIILYDSSKEDLEQVQVQLQAEANSINSKSEK

SEQ ID NO: 20784 - protein, 363 aa, Candida albicans
SDISHNSLKFCFNNFFKIIFLTIPQTMSFFTEPISRLKWGIFPTRRIVDEDEHGNFIDPDTIIADSSLAPPSSDDVASSDEHSGSQEKLESKEATQLISTTTTTPKATPVVLEYRDEKNRPWWKFFDEYEYRVTSNVKSKRKWYKWFHEDDTPEERRVIMKIDILLTLYSLAAYFVKYLDQLNLTNAYIGGMQEGLGMKGNDFVNTGVMFSVGNIIFQIPFMYIVYALPLNYVLPALDLGWSILTICLYRSGNVHGLKALRFFIGAFEAPSYLAYHALFASWFKGSTGEIARRAGFYYLGQYLGVLTSGLLSGAIVRHLDGAAGHAAWQWIFIIDGIISVVIGIIGFYMIPGTPQDCYSILLE

SEQ ID NO: 20785 - protein, 220 aa, Candida albicans
FVGEGKIVFQQLANKSVSNWVLGEQQIGCCNWPAYFSTWLRLTLKKPSSVYNSYRSIISGVGIAMALLSAYLNDYLGGRKNVWFVSGFFVPLIIGCALLAKWNIPIGLHYVWYFLFGVPTSWGQPFIFSWINRLLYHNDMKRNFVVVVTNTLPYVTGAFVPIFVWNTNDKPEYFIGFSYTAALSALGLVATFVAHYLTIQDENGVTLKDLELYGSTEFSK

SEQ ID NO: 20786 - protein, 131 aa, Candida albicans
LLTSRNMSFFVELWESVFTPGTTPALITATHASFILLIISLLVLIFLTKSIHFINLLVIAVLLYASVFWFINELQQVKLQSNNELSQKELEKESESEKLSANATESSQDHWQPSEDIKLRKEKGINPSSTL

SEQ ID NO: 20787 - protein, 822 aa, Candida albicans
ECDAPNANLYSFKGTIHYENFDSKGNLVNEDEKEAITPENVLLRGCTLRNTKWVIGFCIYTGPETKIMLNSGITPTKTSRISRELNLSVIINFILLFVLCFVSGLINGLFYRNENNSRVFFDFHPYGKTPAINGVIAFWVALIIYQSLVPISLYISIEIIKTIQAYFIYADVKMYYDRLDFPCIAKAWNISDDLGQIEYVFSDKTGTLTQNVMEFRKCTINGKSYGLAYTEAQQGLDKRAGIDVIENANKWKNKIAADKEVMMDDLTKYSNNDQLREENITFVSSQYVRDTFLGDSGDDQKQANERFMFALALCHTVMTEESESDSTLRDFKAESPDEAALVSVARDMGIVFKKRLRSSLLLEIYGEEQEFHLLDIIPFTSARKRMSCVIKTPDNKIILYTKGADSVIFQRLNPRENPNELVSKTALYLEDYANEGLRTLCIASKVLDPQVYDNWNKRYREASSSISDDREVLMGQLEEEIEQDLVLLGGTAIEDRLQHGVPQSISILSEAGIKLWVLTGDRVETAINIGFSCNLLENDMKLLVVRPESNDTQDCEQIDDLITKYLQEEFHIDASSPSLVADAIKQARKDHSIPQAKVALVIDGAALSLIFQDLKDCPNDTIRVLQDKFLLLGKQCRSVLCCRVSPSQKAQVVKLVRTGLQVMTLAIGDGANDVAMIQAANVGVGIAGEEGRQAVMSSDYAIGQFRFLTRLLLVHGRCSYKRLAEMIPCFFYKNVVFTLTCFWYGIYNNFDGSYLYEYTYLMFYNLAFTSLPVIVLAVFDQDVSDTISLLVPQLYTSGILGKDWSQYKFVWYMFDGLYQSVI

SEQ ID NO: 20788 - protein, 815 aa, Candida albicans
KQRDIVGVLLVIKHRRLKNENINRSKTFEEKYWHLIKIKGKSHSKNSHSLNKRLLSIRKPNTHRVNFHHDNQPPPQDLDFEEQNDPKNRKSEKRTVTFNRPLPPHLVDPETNKPLTNYPRNKIRTTKYTPLSFFPKNIWNQFMHNVANIYFLVLIILGAFEIFGVPSPVLAAVPLIVIVIITAIKDAIEDSRRTVTDLEVNNQITHILTQVNEDAANGYHYENVNVDDEQVSYWRQFKKWNTRLLIRFWGALKRNLTKEGRANKIRERYNRENNIDGDGDQQQGRKSFDSDIVSNRTSFEQTENPFNDTLRQSFQQQRQKQQRQSSSYRHKTMKFAKKYWKDVKVGDVLRIYNNDEVPADLVILATSDEDNCCYVETKNLDGETNLKVKQALKYSSINEKIHKADDLINHDFEIDSEGPHANLYSYQGNLKYTNRMNNSQSYDNHEDSQEAITINNLLLRGCTLRNTKWAIGIVVFTGDDTKIMLNAGVTPTKQSRMSRELNYYVLLNFILLFVICFISGLVNGIYYRETNTSRDYFEFGTIASTPALNGLVGFFVSLILYQSLVPISLYITIEIIKTAQAFFIYSDVGMYYSKLDFPCTPKSWSISDDLGQIEYIFSDKTGTLTQNLMEFKKCTINGVSYGKAYTEALAGLRKRMGIDVEIEAAQERELISRDKEVMIEKLHTINKNKTYDDEITFVSLEFIDDLTDSSINNQLQRESNHHFMLALALCHSVMTEPDPKQPNKLMLKAQSPDEAALVGTARSLGFHFKGTTKTGVIVDVHGETKEYQVLNTLEFNSTRKRMSSVFTHAGRKIHA

SEQ ID NO: 20789 - protein, 185 aa, Candida albicans
DEPRALLICKGADSIIYERLSATENDPSMLEKTSKHLEEYATEGLRTLCIAERELSWKQYVEWNKRHQAAASSLDDREAKMEAVADSIERELTLLGGTAIEDRLQDGVPDAISILADAGIKLWVLTGDKVETAINIGFSCNLLGNDMQLLVIKTAYNDDENGSNDDNSSEDLHPRGLEGHTLAGA

SEQ ID NO: 20790 - protein, 130 aa, Candida albicans
PFAMSESKDQSTDSTGSPGLQSRGEPQPPSFREKIHRFFFLKGLADRPPYLQEIYDNTPRTVFYNYDLPDYMIDSQGRPITQYPRNKIRTTKYTPITFLPKNLLLQFTNVANSYFLLIVILSFTTRRRTE

SEQ ID NO: 20791 - protein, 167 aa, Candida albicans
FSAMIPSFFYKNIIFNIALFWYGIYCDFDGTYLFEFTYLMFYNLAFTSLPVIFLGIFDQDVEAKVSLLVPQIYRTGITRTEMSDLKFYLYCLDGIYQSAISYFFPYLLYMVAFPNMNGKPVDHRFWMGVLVTCIACISCNCYILFHQFRWDWLSSLIVFTTRWKDHA

SEQ ID NO: 20792 - protein, 818 aa, Candida albicans
  UNSURE (31): Identity of amino acid sequences at the above locations are unknown.
NMGPRKNFISKGKGRKFPSPRNKHGRLEIHXDNPNKVQEYPNSLQLLRHYSFTPSNFVCQKTQFLLLSIALCNTCLPKKKENESKCNSNNSTFSLEETGTEEDPQDDACITYQAASPDELALVQAARDLGFVVYDRQNSKLTIKTYPDGFSNEPKYEEYQVLDVIEFSSARKRMSIVVRFPDNRICLFCKGADNVILEKLKNSKLAQAKAREISLQSAERKTQEADVILQSRLSQEVEARKSGLSFRHSLNLGSANSTRINTIDNALMGTEDREIADIALKARKSLHFQQSKKYNLDSEECEDGAETSPNTTTVGGISSELPPHYIPNDKLLVNDEFLIEKTLQHIEEFSTEGLRTLLYSFKWMDKKEYEIWSQEYGEAKTALSDRSKLVEKVGAKVETNLQLLGATAIEDKLQDGVSEAIDKLRRAGIKLWMLTGDKRETAINIGYSCRLIKDYSTVVVLSNDEGRDALVDRLTSSTQEIKAGRVAHSVMVIDGGTLADVELDPTLLTSFLELCVEVDSTICCRASPSQKANMVTAIRNLKKDCVTLAIGDGANDIAMIQSADIGVGITGKEGLQAARSADYAIAQFRFLLKLLLVNGRYNYVRTSKFVLCTFYKELLFYLTQCIYQRNTLFSGSSMYESWSLSMFNTLFTSLPVICVGMFDKDLKPATLLAVPELYAKGRLYQAFNLKLFISWMVLATLQSVGISFLSFYVWGFTALRDNTTFALGSLVFTVLVVVINAKCTLIEMQNRQWLAWASFIISVGGWGIWNVLIMGLYRHKQPTIFFVDYGLIMWGRDQSWWATLLLMITIPLFFDILG

SEQ ID NO: 20793 - protein, 330 aa, Candida albicans
SFREHHTSDNNNKNMSDTQTSLTSQTGIQNNSNSLEPSNNNSLQVPTPPTTRRKRGLSLRSQLFNKAFNIQPQPSEEIQSSVPHLQSPESNNNLANETNTYPTFDHPQQNIELQNIPITPEINVYEAPDQFPTSLTSISNNDLHTNYPSHLSRSTTHLTAGSNRTSISTQSFISKRERSDWKRYGSKNRFYQVLVDIKNRIFHIKDLPPTEEGRIIPLTVDPKFTNSYYQDEYYDKKSKGYIDERSNEPYIDNMITSSKYTVYSFLPKQLKAQFSKVANCYFMVVAIMQMIPGWSTTGHFTTIIPLCIFMSISIAREGFDDWKRDRHDKE

SEQ ID NO: 20794 - protein, 193 aa, Candida albicans
SLNNLLAISSASSLSDIDDSVSKEDLCFTNSELMRRYNLKEYTTKWKNVKVGDIVKINENEWFPTDVILIATSELETQEAFVETMALDGETNLKQKSPHPEIAKKASTVTGLKNLRTLVTVEDPNKDLYNFEGSFILNGAKHPLGPDNVVYRGSILRNTKSVLGLVIFTGEETKIRMHNIKNLVFSPGWKDRS

SEQ ID NO: 20795 - protein, 331 aa, Candida albicans
TLMGFIIMYNTLIPLSLYVTMEIIKVMQLCFLQFDIDMYHVETNTPADAKTATILEELGQVSYIFSDKTGTLTDNKMIFRKFSVCGVSWLHDLDIMLSEKQEPNSQVTAPLVPRHSVHIQSPVTNRKSINGRSSIESTHRDSTTSIVRESMDIPSPRTSTAAWKSSAQPNKVQDLSNSLQLLRHIQSHPQTLFAKKAKFFLLSIALCNTCLPKKKENESKCNSNNSTFSLEETGTEEDPQDDACITYQAASPDELALVQAARDLGFVVYDRQNSKLTIKTYPDGFSNEPKYEEYQVLDVIEFSSARKRMSIVVRFPDNRMSLFFTSHCRSS

SEQ ID NO: 20796 - protein, 267 aa, Candida albicans
  UNSURE (256): Identity of amino acid sequences at the above locations are unknown.
IYGVLFLTPTGAGSKFGWIGRSPCVACVVGSAFPRGPLMICSSWYDKKTLASRNSILYAGLLISSAFSGLIAAGILKMDGLGGVQGWRYLFIIEGGITVLTVPFAYFILPDNPSNTKFLSQEEKDIIMWKMKRDLGNVNDSDKEAQESEIQGFMHACKDIKVWLLCAIHLFLVAACGVTNFFPSVVQTLNFDSTTTLCLTVPPYVIAVVATYLWAKHADHSGERFYHVTIPLVLSLVAFIISAASLNTGARYFSMXFTSGLAGPNLR

SEQ ID NO: 20797 - protein, 481 aa, Candida albicans
PFHFVNNMTTLAEEKHTTDMSKDPEYISSDDSFPEDIAENKVDPEIEVEQLAQELGINQKKLMWKIDLWVVPPFCLLYFLSFLDRVNISNANIYGLTADLKLTGNQYNTALTVFFVPYVVFEVLANYCIKFVKPHIWLSTLVLLFGGISIGMGFVQNFGGLLACRFLIGVTEASTFPSIFYLLSTYYSKAESPRRFSAFFSCTALSGAASGAIAYRINELNMVHGLESWRWIFIIEGAITAGCAILLFFIIADFPEEARFLNANERTFLKRKLEILAGTKSAYEIKNTIKDVAKCFKDWLIWLPALSYFGLIIPSYGYAYFAATIIKQMGYTAVSAQQHSVYPWVCAFGVINVVAFISDRFKRRLPFAIGTCIMAIVGLAMILGATHSPKVRYVGCFLTASGLYTAMPMVVCWAALNNGSHIRKSVGTAWQIGFGNIGGIIATFIFLAKDAPVYKPGLATSIAGVCFSYCAPWAISLFVIK

SEQ ID NO: 20798 - protein, 510 aa, Candida albicans
TPFLDPKVAEYYDTMYRTSNYESYSAFDPFFEWDEKEEKKLIGKLNYRVALTACFMFIALQVDRGNLSNATSDNFLDDLGLTTNDYNAGNTIFRVAFLLAEIPSQLISKALGPDIFIPIQICAWSIVAMCQAALSGKASFFVTRLLIGAIEGGFIADLVLWLSYFFTGERVASLDYPGVWTTLSLVDIFNSLAAFGILRMKGLAGMAGWRWLFLLEGAFTLLIGIFSFYLMVPSAVQTKNWMHPKGWFTDREVKIVVNRILRDDPTKGSMHNRQGLTIKQIIKSFRDVDIFPLIAIGLINFIGSSTFGSYFALLNRQMGFSTFDTNLLMIPPKVLHIGFLLLITWLSEFINERSGVCLIAPIYSATIMAVIRWWPGSGKQVWPTYVLNTLYSGQPYIHAILVAWVSRNSNGVRTRSISSALYNMSVQLSSIIGQNVYRKDDLPLYKRGNMQLFFVEMATIPIIMLTKAYYVFKNKRRDKIWNAMSEEEKDDYRKNSKVEGARRLDFRFAH

SEQ ID NO: 20799 - protein, 413 aa, Candida albicans
FLVDELLSQLMSKALGPDIFIPIQMCARSIVAMCQAALKGKTSFFVTRALIGILEGGFIADLVLWLSYFLTSKELPVRLSWFWTTLSLVQIGTSLLAFGILRMRGVAGLEGWRWLFLLEGIITLIIGIAALYLMVPSAVQTKNWMHPKGWFTDREEKIVVNRILRDDPTKGSMHNRQGITPKALWNSLTDYNLWPIYAIGVVAYIGTSTFGAYFTLMNKQLGFSTFNTNLLTIPQAVLHIILLLAITWFSEKVNDRAFVALIAPFYALPLIAIIRWWPCAGKNIWATYVLNTLYVGQPYIHAICVSWVSRNSNHVRTRSISSAVYNMFVQLGSIIASNIYRKDDLPLYKRGNMQLFFITLTLIPVLLLAKGYYVWQNKRRNKVWKAMTEEEKDAYRKTTKDEGAKRLDFRFSH

SEQ ID NO: 20800 - protein, 107 aa, Candida albicans
YTMPVTEKDIANLGANSIASNNTSSSLKKQDNKIITYTESNSSLESDEISKNPFLDPKVEEYYRDLYEDSNYESYRAFDPQFTWSKEEENKVIKKINLRVALTDYFF

SEQ ID NO: 20801 - protein, 597 aa, Candida albicans
STHVSLIYCLVSSLIVYKRPGYSSIYTKQFRELVVVIYQFDATVMTATKLSRSLSSSSNVTTPLLKKDDYTITIVPSNSSSEANEIGDNPFLDPKVEEYYREVYQTSNYECYPAFDPQFEWTKEEEQNVVRKLNYRVALAACLLFVGLQIDRGNLQQAISDNMLNDLALTTNEYNLGNTLFYSCFLLAEVPSQLISKSLGPDIFIPIQMCAWSVVAISQAALSGKVSFYLTRALIGMLEGGFIADLVLWLSYFFTSKELPIRLSWFWTTLAVVQIGSSLLACGILKMRGLAGLEGWRWLFLIEGVITFFIGLSAFYLMVPSAVETRNWMHPKGWFSDREEKIVVNRILRDDPTKGSMNNRQALGIKELGASLMDYNLWPIFAIGFIAHIGKSTMGTYFTLMNKELGFSTFETNLLAIPPSILHISFLLGITWLSERANERSFVSLVAPLYAVPLIAIIRWWHGSGKQVWATWMLSTLFLGQPYIHAICVAWVSRNSNSVGSRSICSALYNMFVQMGAIIALNIYREDDFPLYKKGNTILFLIELLLIPLLLFTKCFYIWKNNQKGKLWNKMTEEEREYYRKHSTDRGNERLDFVFEH

SEQ ID NO: 20802 - protein, 417 aa, Candida albicans
YGQRYSWCAAIFNFGYLAGALPANYVIQKLPVAKFTGCMLFLWSIILIGHIGLQNYGGILVIRFLLGLFESMISPSCMAICNNFYTVKNQPLRMCIFLSFNGVATIVGSLLSWGLGHADESKLKIWKLIFLVIGLMNFVWSGIFLWLCPDSPKLVKFLTEDEKAVLIKEVATNNQGLGETRFKKSQAVEALQDLFVYFVALIGLACGVINGGTSNFASSLIKGFGFTGIQATALQMPLGAVELVVVVAAGIVVFTVKNMRCIVLFVICIPPLPGLIGLHVIPLTHRWALVGCSFLQFIIGGPVILCWILSNANVSGSSKKTIANGIWFVMYAAGNIISPNIFYAREAPKYRSGIIGLISSYCGIMVLAIAIRLVFMHRNRKRNLEQGGYNEQIAEQAVLDGFKGLTDFENAGFRYSL

SEQ ID NO: 20803 - protein, 520 aa, Candida albicans
IKALFQYEIVLSFFLLCLGNIYMSEKLSTAVTQDESVTDTSEFDNVLYFIKENEQIIDPDSTIDGAKIVRKLDLIILPLLCCIYFLQFLDKSLLNYAAAMGIKKVLDNHGVGNNQFANLSTMFYASYIFGEPIMSYILQRYPLGKSLGVCIVLWGVVVTCHSACSSYASLMIVRTLLGIFESSSAVGLITISGMYYNKRQQVARMGIWSVMAGTATIFGGLLSFAFQHIHVQKFKSWQILFLVIGLITIAFGFFVMVYLPDNIDTVWFLNKQEKLYILNHTVRPNQTGTKSSKFKWKHIKELLILDKFTWLYFLLTICSQIVTGAIGTFSVTITLSFGFDSYQSALLQLPIGALIIIIILTATQLVSQCGHITYIIISMYIPTIVGAIVLIISPNKIGNIMALYLLYSGSSVITLIYSWTSVHTAGTSKKIFRSGMIMIAFSIACIIGPQLFQNYSAPKYHPAKIVILITQCMCIPITWLIGWMCQQENSKRDQIKDQMPENFEFFDLTDLENTQFRYSY

SEQ ID NO: 20804 - protein, 226 aa, Candida albicans
PHNSISSLIGRLCIVVMVSLSFPLQCHPCRGSINHVIHFCTHGVQQSKFRSTTTTNNNNGDQHGYTSLSSDIESLQSIGGNDTTAGSIGSIGGGDSVVGDADESFISTTPVEGAQDTDGHDPIIVPMTTKKFYIITTVIVVLSYLVAISVTSLAHVLAFVGSTGSTSISFILPGLFGYLLIKPIDGNTSLNNLQKFCKYGGLFLAIWGILVMIVCLSATIFLGATH

SEQ ID NO: 20805 - protein, 170 aa, Candida albicans
ILRFLKVLFFYFFLSFFVLFLHHQHMAPSSSSSLDLHYERPKWYRLAIYDTLLWLLSVIFDCFFREIRPRGAFKIPREGPVIFVAAPHHNQFVDPVLLMNQIKKEANRRISFLIAAKSYKLKAVGTMAKCQLSIPVVRPQDCLVKGTGKIFVDFDKDPLRVTGKDTKFTK

SEQ ID NO: 20806 - protein, 597 aa, Candida albicans
SFVKNFNLVDKVKVLLTTGTGYKGANKIDQKQVYPNVFDHLLDDGSNGIFPEGGFHDRHDYWPLKAGVAVMQFGAMDKNPGCNIKIVPCGMNYFNAHKFRSRAVVEFGDPIEIPKELVKKYANPETNREAVKELLDTITTGLKAVTVTCEDYETLMLIHAVRRLYAGNFAQQLPLPLIVEMNRRLVIGYQHFKNVPKVQEIKEKVLHYNDFLKTLYLPDHDVESCNDEAHKITLIPIFFFRVFKLLILFILALPGATLFSPVFLSTKIISKKKAKEALANSVVKIQANDVIATWKILVSMGIAPIVYSFYASVGTYYCSTHDYFLHWKLFWVWIFLYSCGVLVTYSALITGEQGMDLFKSIRPLYLSITSGSSIKELKKMRHELSEEITELVNHYGPQLFPNDFNLLDLQKSLNINGDVVYADSDEEEDMKTEELRNRRIARRKAEKKKKQTQENEDTQELQSSDMKHSSSMSDGISLLNSDNSLTNLPMFSDYVLHKNAKNPDLQLDPQSHYGSRVNSNLNSSANSSVSIYDDYRFASQSEHGGTASPVRYSRLPHLPETSSSDHMELNFASKPEGQKMRLRDRIKTKLRENRKEN

SEQ ID NO: 20807 - protein, 223 aa, Candida albicans
RRFGQLPWLKTGPVIFVIAPHHNQFVDGLVVMTKVKEILNRRIAFLIAKKSYDRMVIGQAAKLCGCIPVERAQDFLKLGQGKVFVDPNDDCVLIGENTAFTKQCQKKGLIGLPNSLGNCQIASIEDDTHLTLTKPFGSKNSEIQSRIDKAFRDGTSFKIAPHIDNHVVFENVFNHLNDGNILGIFPEGGSHDRPDLLPLKPGVAIMALGAIAQQMEGLGRERL

SEQ ID NO: 20808 - protein, 168 aa, Candida albicans
SIFISRIKIINICMAISGFILSICWISLISDEIINILHIISIIYQLSEDILGLTIFALGNSIGDFISNYTIAMMGKPIMAFTACFGGPLLAICSSGLSGMIIRDGNDKKLEMKLTNTLIIICLSLFATLCFLMYIVPKHDWQINKKIGIILVSIWLITCSLCIINEIK

SEQ ID NO: 20809 - protein, 508 aa, Candida albicans
  UNSURE (8): Identity of amino acid sequences at the above locations are unknown.
IFYRFFFXWISPTALAFNPSTNTSFLYYKTNSSDCSLVINQPLSQQCQFINDNNCQSTGLINYYKLYYCRLSFLHNPSSPFLIQTLSILPLTICLILCFISVGITASEYLCPNLYTISQFLKLPDTLAGLTLLAFGNSSPDVFGTYHAIGSNSLNLAIAELIGASLFIMTVVVGTIAIIEPFNVPKNLFIRDCMMYIMVFALVVISLIIGELTSIICILLVSCYIIYVGIAIYSHSQKKTRINRLLREQRSRGQYSVENDGINNDNASVDEIYLDSIASLPTIDDLDLQQINDEVDNLQFELANGNSSTAGGAATATSVGGNFGLKMLINDLHQHSKIKGTIQLNSNRQLISSTENEVLPTAIPTLTPTPTNDHPILNLKTNDLLYLLLPQLNQWPEFSLYEKIYFIISLPIQFSLRLTTPIRDENIINTIMNDIHNLTYNNSNNNNNNNSDSTGTTTTPMGSSFDYLQDKKLLLVQTFPATLFLISSLFGKISSSKPMLKFLSIINS

SEQ ID NO: 20810 - protein, 208 aa, Candida albicans
  UNSURE (4): Identity of amino acid sequences at the above locations are unknown.
SQTXSYQDTVNYCFGVWGKIVLLVSICSFAYGGCMAFCVIIGDTIPHVLKAFIPESITRSDGPLGWLFARNTIIVLFTTCISYPLSLNRDISKLAKASGFALVGMFIIVVLTIFRAPFVSPTIKGELTVKEWTVNANIFQGISVISFALVCHHNTMFIYQSMKNPSLAKFSKLTHISCLVSMIFCMIMAINGLINFGDLFTTEWKTRV

SEQ ID NO: 20811 - protein, 133 aa, Candida albicans
  UNSURE (126): Identity of amino acid sequences at the above locations are unknown.
KKKKRLKFIKHTIGVMGRATIKSGSINLLNTIIGAGILAMPYGLKNNGLLFGCILIIWSSLTSSMGLYLQNKVAKYTGQRGSVSYFSLSQLTYPNLSILFDSAILIKCFGVGVSYLVVSLHHQATXIIAMVRK

SEQ ID NO: 20812 - protein, 265 aa, Candida albicans
KKKKRLKFIKHTIGVMGRATIKSGSINLLNTIIGAGILAMPYGLKNNGLLFGCILIIWSSLTSSMGLYLQNKVAKYTGQRGSVSYFSLSQLTYPNLSILFDSAILIKCFGVGVSYLVVIGDLMPKIVESLVGGGNINLDSLLMARNFWITIFMIVIVTPLSYLKKLDSLKYTSILALFSVGYLICLVVAHYFTTPTTSPSGGGGGDDDDIVYHYIGPISLKSTLSSFPIFVFAYTCHQNMFAIINELKPSDTDGSQTRQSNLIIS

SEQ ID NO: 20813 - protein, 399 aa, Candida albicans
LMPSIDNDAGASTVSSSISLVKTIIGAGLLSMPLAYSTDGIIFGTFIILLAAFTSGFGLFLQCYVSRYVPVKHATFFNLCSITYPHLSVVFDFAIAVQCFGCAVSYLVLIRDLMPTIVTYVPYIDEKHYPLFWLLVSTVLTIPLSFLKNLDSLKYSSILGLVAIFYMTILVIGHYFAGDIERQGQITLFPTSVTGVFSTFSIIVFAFTGHQNMFSIINEARDKSLTSLTKLVNFAIGISSLLFIAVGLSGYLTFGQDVDGNVILLYPNGLTTTIGRFCIVFMVTFSFPLMIHPARISINNIYHWVTTNYFDKDEANESTALLGNESQESQIAEDEEQGKTHLSHVVPFPHKHFVIVTTSLLIIGYLLAISIKSFALILAIVGASGLDFDFLYFACFIWL

SEQ ID NO: 20814 - protein, 239 aa, Candida albicans
IYIFIYSIPNLPDHTLYKKMSNDPTPILDNAKDSSQVPDFSDIVQGEDLEFRQSKAPTFPVVHKIEKLGEIPPPTILSRLSNNQLITIAGAASGFLAGIVVCPLDVVKTRLQAQGTVGENLKYNGFLGTFKTILREKGIRGLYRGLVPTMIGYLPTWTIYFTVYEQAKRFYPSFLHQYNIENPSIIHFCSALTAGMTSSIAVNPIWVVKTRLMVQTGKEGQQVYYKRTFDAFKKMYQHQ

SEQ ID NO: 20815 - protein, 483 aa, Candida albicans
IYGISTTNTIKTFYMKDNDAFYSYDDNSIPSENNSNNQTEHMDFPLPPPIDWSNNSVFDETSELLPTLSRVSTKRHSFSLITGNSTAAQTIFNSINTLIGIGMLSLPLGFKMSGWLFGSLLLVVSAFLTNTTAKYLGKILYRHQELMTYGDIAYAYGGKYFLYLVTLFFVIDLFGASLTLIILFADSFTIVWPHVPALKAIIVAVVFVLSLLPLSMLSIFSLLGIISTVGIILSVFICGFLVDTSPGSLLIPATTTLLPPNPINLLFSLGIFMAPWGGHPVFPELYRDMRHPFKFTKSSNISFLVTYLLDFSIGATGYLMYGLMVDDSIVKSIMQNPNYPPIINSILCILMGILPISKLPLVTKPIITSYENIFGITAKYVKLDENGKLTDTYGPTRVFSTLSFCCVLLISALLLTSFGKLVAFLRSAICDTVCLTLPLLFYLKLNRSSVGKLERLLIKIGIVFSITATILGTYASIGLTIPE

SEQ ID NO: 20816 - protein, 511 aa, Candida albicans
  UNSURE (434): Identity of amino acid sequences at the above locations are unknown.
YIMIEEDENTSLLSRRPSHSFLDTPIGSFKGPNSLHNFASSFTRAQSFAANKIDNSIHKKRSFFVSGDGGTVEDDETFDPELLVPSYRGERLSTVMHDIQSRNQLFMNPPNQLDQSVSPNNDVFFHDDVMNALNESRSRQNSTFGNSQFKHRIYSAPSFSSFRSSISAATTPSIFQVRKIEDEDGNVVTVLAGQSTAPQTIFNSVNVLIGVGLLALPVGLMKAGWVYGIPILLVCGLTTYWTACLLSKAMDTDDTIMTYADLGYAAYGSMAKLVISVLFSIDLLGAGVSLIVLFSDSLYALLGDDQVWTRTRFKILSFIVLTPFTFVPLPILSIISLFGILSTISITILVMVCGLLKPTAPGSLLETMPTNLYPKSLPDLLLAIGILMAPFGGHAIFPNLKSDMRHPYKFTQTLRSTYSITLLTDCSMAVLGFXMFGQNCSNEVTNTLLTTAGYPKWCYPLISGLICLVPLAKTPLNCKAHYFNIGFVIWGSPNLAPNQIGDTVHSLRKNW

SEQ ID NO: 20817 - protein, 156 aa, Candida albicans
AIEKKKKQKKTPLPSFLSSADSFTPSVSFIHLFLQSTPPPPPLSPINMHLWKSLSQSNKNIKILWGSVFLKMANYGLTNQVLTLYLKSLNINETKIGLFMTLTLIGDTIISYYLTWNADEKIGKRNVMILGTIMMFFLGIVFGSNIQVDNNNNNNN

SEQ ID NO: 20818 - protein, 97 aa, Candida albicans
CFFWVLCLDQIFKLITIIIIIINMEVHLYILSMAAIFGVISPGGDETGPFKSVEEASIAHLTPHNHRPEIFAFYGLFATAGAGRGTSLCGISVDYWN

SEQ ID NO: 20819 - protein, 191 aa, Candida albicans
LRIFQVGFENRLWMVPNAWIVYYLKITFELTAISLGILFFITNSVDSISSLPSAYLSKLIGPVKTILFTQIPSAIFFGLTIIPSNYPLVAILLILYFTTSTMDVVPRQVLLTSIMPKQDITKVMGIVNIGKTLARCIGPIITGKLASINKLYVGFIINSCCVLLADMILAINFLHLDEEILLKQSIIQEIE

SEQ ID NO: 20820 - protein, 480 aa, Candida albicans
NLLFSIIPSLLLIEIYRLLKSSTMSEGWISFLIDEIGLYTLSNAGTDVYIIILLRMIRLIGFGATSLILALFLKSLGIPEQYIGLFMTLTFIGDLVSSFLLSIITDQIGRKKMLLACSVLMTLTGAVFGLSENYYVLVITAILGILTPSGGEVGPFRTVEQSSIASLVPHEKRSDIYAWYTFLGTFCAAFGSFLAGALIDIVQDNYGFTIVQSYKCVFWVYTLLSGICVILCLFITGNIEVKPDPGLEEPATTPEDNESEPTETSQLIPTTGNVTNKPKNKFRLLPHLSPDTYLLVIKLSLLFGLDSFASSLTPISWISYYIKNKFDVPSSYLGSVFFTTGFVSGFTSLGSTPLTKRFGAVVTMVFTHLPASILLALVPLPSSFSLTMGILVVRACTQTMDVAPKHVFLATLVSDSDRTAVFGFVNVVKTLAQVVGPSIVGVITQRGAQWISFVIAGSLKATYDIGMLVTFLTYNRHAVH

SEQ ID NO: 20821 - protein, 443 aa, Candida albicans
HTLIKMIKTKKNLSSEETTDSIELQQPDTSPEQLESATEKQEHDPDIDGGYAWIILFACVLFNFCTWGMNSGFAIYFANYLSQGTFKGADKMDYSYIGGMAFGVGIFFSPVITVLMGVLGFRSVLIIGNCLQFASLMLASWSTKLWQLYLTQGLMQSFGLAFISIPTITILPQFFKKKRVLAGGIGSAGSGLGGIVFNLAMQKVVDTKNVHWALRAQSIIAFGLTWIAIVLVKTKNSKHNIQFKLFDFGVIKTAPFWLLIFFIITCIFGYVIVLYTLANFTTSLGYTEREGSYVSATIQIGSCVGRPLMGLLSDKYGGATVASVGYFIAGIFCLAMWIPVRNLATVIIFALIMGAIMGAIYGMIAPVVARLFGILKMNVVFSQIWSFMGVAGLFSPVIGVKLTKGSGVGIDPTRYVNCSIFTGVCFIVCSATLLIIPRLRQCS

SEQ ID NO: 20822 - protein, 287 aa, Candida albicans
SAVPSSPRGRRTKAIQKNQQPPNFLTQNFMEFLSIYGHFAGEDFSDEEEEGDEGDEEYDNGHDGDEVFDEESSLLGNERRGGGSGGGQPFRQLPKKPHSHPQKQPPKGTASVFKTFLLLFKALVGSGVLFLPRAFYNGGMLFSMITLSLFGLLTFFCYIGLIESKTILRLSSFGELGYKTYGKPLKYCILVSILLSQIGFVTTYILFTAENMIAFLSQYVSTKNNLLSQEVLPNWLNRGNLILIQCILLIPLVLIRNLAKLSMVSLISSVFMVIGLLIIFWVFRKLI

SEQ ID NO: 20823 - protein, 143 aa, Candida albicans
  UNSURE (6),(10): Identity of amino acid sequences at the above locations are unknown.
PPTRIXQRRXASIHGSTDEGNTNNTDDNDGKLYHQSGKYNPQVKWLKNGFRAISVIFICSLAYLNADNIDKFVSFNGCFACIPLVYIYPPLIHLKSIQSKQQQQQQQTGRSKSDQLFIWLDYLLIVVGIATVIYSSYQIIFLN

SEQ ID NO: 20824 - protein, 415 aa, Candida albicans
  UNSURE (58): Identity of amino acid sequences at the above locations are unknown.
TISIPNKFRSRVVIEFGKPLVVDHSMGKEYMEHHRDTVDKLLKVVTFGLKQVTLTCDXYDTLMVLQAARRLYTSTNREQIPLPMVVEMDRRLIKGYQQYKDEPDVKKLRDAVYHYNRTLMRLNLHDHQVESLDKFDKLKTFQMFVSRFFKFSLFMGLSLPGIILFSPVFITSKKISVRKAKEALAASLVKIKAKDVISTWKILVALVLAPALYIFYSVIGTYLIVKLQIVPQLSTIIIFIICYGWAVLTTYASLRVGEIGVDYYKSLKPLFISLISYEKDQLQIRELKKTREELRQRVNLFCNNYGPGMFQDYDEFYRNYNQMETETDYDEFKQSHKPLRRQNSWTSMDLTLNNLSDIPIFSAADLEQSNDISTSELSDEVNDEKEVEVEDVGDHSNEVSVRLRNAIRERRQNSF

SEQ ID NO: 20825 - protein, 447 aa, Candida albicans
RKFYILGYSLFLKKTKYKHISKMVNTTSTSRRREEEENSPTKSSVSSDMSHNSFDDDDGLEDVEEINTNQVEEYQIRPIQSQQSTSSRLSRTRTNHSELSRIISGIKDDQQLDEQNRNNYKHTGDAEYILANEIDRVATNIIDSRQHSTTDLELQRRHLHLQEVNGLSRNPRFSGSPDDLSINDEEEEEENEKKGEFLQESSHKPDGGMAWLMAICAMMAMFSTWGANAGYGVFLNYYLDSNTFPEATKYDFALIGGIVVFMANILSPLSALLYKMLGFRFVCCIGIIFQTLGWICASFAKRIWHLYLTQGVLVGISFLLIFIPATLVLPTWFEKKKATSMGICVSGAGLGGLIFSLSVNKVIQETGNQRWALRMVGFVTLFSALLSALIMKPRNFTQPPLKESLSKTFIIESVKAIFDVRVFKNRGIILIALWFSIALIGYTLIVA

SEQ ID NO: 20826 - protein, 165 aa, Candida albicans
WCGFSLGQPLAADVLDPHMEQMPAAWSGINITVSFFCLVSEVIALALVIPGAKRPYLHTQIFAGSCFFACFLLMILIREFLIKKQLTSRLEFTKNKLHKVAGTTKSDYLRCQDDEQQAKKDSEDTNKKEEEEEESILIERVERYEQLLNNTFTGFFIRALYPIKV

SEQ ID NO: 20827 - protein, 230 aa, Candida albicans
TLAYSQSPLSNHMSESTFFTSLISGACAGIATDIVFFPIDTIKTRLQAKGGFFTNGGYHGIYRGLGSCVVASAPLASLFFITYDSLKRDLPPAVSSLGVRHMIAASMGEIAACIVRVPAEVIKQRTQASHMGNQTSWSNLLHILRNSNNEGVLKGLYRGWNSTIMREIPFTMIQFPLYEYLKVQWQQNLNSFIPQGFKGAACGMIAGGVAAALTTPLDVIKTRIMLHKDR

SEQ ID NO: 20828 - protein, 140 aa, Candida albicans
  UNSURE (10): Identity of amino acid sequences at the above locations are unknown.
KYLDLCLTFXGRYNVYVFMLILYCLCIFVLLYPFGSSEKILYAFAGVGGYCSGSILGLLPACLSQITPVNEIGTKYGILNAVLSLANLFGIPIAASIIKDGTPKEYNNFVVLVGCLAVAGTLFWYFSKVAILGFKLNIKV

SEQ ID NO: 20829 - protein, 105 aa, Candida albicans
  UNSURE (100),(103): Identity of amino acid sequences at the above locations are unknown.
IYLVLLQIPNSMTNTISSFESVELTAVSLRHQIQFRPEDELSSDSLTPIATVTEDDSSIEYPEGGLKAYSVILGSFLGLIVNLGLINSMGPIQAVADRAXNKXNV

SEQ ID NO: 20830 - protein, 328 aa, Candida albicans
IYLVLLQIPNSMTNTISSFESVELTAVSLRHQIQFRPEDELSSDSLTPIATVTEDDSSIEYPEGGLKAYSVILGSFLGLIVNLGLINSIGAIQAYVSTHQLLNLKATSISWIFSIYLSLAYAGGIITGPIFDKRGPLEILIVATAFIFLGLMGAAQSVEIWQFILSFISLGVGSGLGTTPLIVVISHWFCKKSGSFTGFATSGGSIGGLIFPLMLRHTYNVYGYVWAIRILAFMSLGCMVCSIFLVKERFHKVKTEVIAQQTQKTKFLIQVLMNKLKSVNASDFKYIYVILGAFFAELSLILLVTYFPSYAIAHVLHFHQAAGRTKIK

SEQ ID NO: 20831 - protein, 345 aa, Candida albicans
  UNSURE (51): Identity of amino acid sequences at the above locations are unknown.
LIWIVVIISGFVKLNYGYSYNMDTCTTITPNDSNPQEYGPQLIELTTSNSXDDRHNVNNNDNCLNENNHSIITRSITRSTTTISHQSSSLHLLDDPSKFPDGWNNRAMITLFGSFLGMIGSLGYVNSGGVIQSYISTNILINDSQSSIGWIFLIYNFFAFGGILILGIIFDKFGCKIPIFVGVIIMFSGLLATSFCHSLYQFILAYSILAGLGTAFVFGPFVACLSHYFLHKRALVIGISYTGGGLGGVIYPLMCRSLFSKIGYGWTMRIGAFISLFCCGIGWLLVSDRHEEFSPDLEKKKKKKKINQEITTTSSNNSVIDQVENEFISIIKSSPRELAGSALML

SEQ ID NO: 20832 - protein, 381 aa, Candida albicans
FKYPVRPLPVVKTTRSWIFSIYTAISFANCMVVGPLFDVKGAMLPMVVGTVMISSGFMAVANCDTVPQFILALAICVGLGNSLNITPLIGVLSHWFNLKRGRAIGMATIGGSVGGIIVPLMLRSLYTNVGFVWAIRILGFFCLACNGIAILLCRSRICQESDTVTPKNLLWTNLVQIKDQFEFSALLDPKYSFCIVGTFFTEISLLSMLTYLATYAIAQGMSESQSYVLLTVFNTTGVLGRLVPGILSDKFGHFNIMIAMLIGFTLSMLILWLPFGSNIGALYAFAAISGFFSSSILSLTPVCLGSITPVQKFGQRYGLLYFFVSLGNLFGIPVSAAIIGNGSKHLYDMFAVYCCVFGVVGTCCWFISRFYIVGLKLNVRV

SEQ ID NO: 20833 - protein, 615 aa, Candida albicans
VEDIDNMKTVRTNDHDTNNGKFLLGCLTTCHSLRNIDNELLGDPLDVKMFEFTRWNYKEDSKTTNPIVFKGNDSYEVNKEFEFLAPLRRMSVVVSQNHKHYIFTKGAPEVMLDICLPESLPTNFEELLHHYTHSGFRVIACAYKQVSSADIDRETAESDLAFAGFIIFENKLKKSTKSTLKTLKEAEIRTIMCTGDNILTAISVSRECGLIPPSIENIYIPVLDEKNEERYISWQEVNDPENKLDPITIKPIDIRQDNNYKLAITGDIFRFLLTEVKNISVIQNILMNCDIFARMSPDEKHELVEQLQKIDYTVGFCGDGANDCGALKAADVGISLSEAEASVAAPFTSRVFEISCVLDVIREGRSSLVTSFSCFKYMSLYSAIQFVTVTILYKTGTNLGDFQFLYIDLFLILPLAIFMSWSKPYAKIVLKRPTANLVSPKILIPLVCHIMVILIFQVLLWSWVRKEPWYIKPIPGSDDAVKSSDNTVLFLFSNFQYILIAVVLSQGPPYREPMVKNYPFMINLVVATFLSACLFLIDGESSLGDLMQLTNLHGWFYWYIIIFSIINLGCMMIGEERWFPALAKVYKRVFQRLKIGKSKKVFKNLKKEFNQLQSV

SEQ ID NO: 20834 - protein, 480 aa, Candida albicans
KMVRNLVTSRRSSSIDRRRSRSRHNSVASASSSVNLLLDDNNYEMYSGAASEIIPSSITSLHYPHSFGGRRISRVSRETSPLLSADENDNDLQRVRSNASRNSIDTQANFRFFSPHEIEHAQGGSTLENPEDPVDYNTDWDYSIDKYLDEDEQYQEEAVADEGEGDGEGDQQRGTAFYQQDGVNFRYLSPEAPDYGSVDFENHNRRDSGSSSKSSLDEANSIVDDNQYEDFYKQFPTKLDYQRYYLAEEDLVIGIAGYADRWWKTAIYYFLCIGTLGIAYLILRWLPRYRINLMGTRCPLGKADWCVIENEFGELQIAHVEKQRFNERLSSFLVGTDDQFDFEKDPVVPHIQSFVYRYIKFFYNPMEDMFKTNSNWFDARWLNVKNLKDGVSHSVQDQRQEIFGRNTIEIEDKTVLQLLTDEVLHPFYIFQVFSIFLWLADDYYYYATCIFLISMISIINSLIETKSTHETFTRNFKIQL

SEQ ID NO: 20835 - protein, 79 aa, Candida albicans
LKQNQPMKRLQEISKFNCEVRVWRNEFWKQIDSNELVPGDLFEVDPSLNVIPCDALLVNGECVVNESMLTGGKCPCFQN

SEQ ID NO: 20836 - protein, 478 aa, Candida albicans
FVDQFHRKKRKGYIKVDGSKLPQDFKLPTLIFHYTDLLNFTNLPNVEKYFEDYAKHQISDSLLDDDQSKFNLKVASDFQIDDAKLYNGYIDTNKNVEYIVYDTGIYCVYIGKLEDKKIDIPVVFKNSYGNLTYIEYTIYSQMKYVIVLAIILFIYLLNYILKFKVGKDFKDLDSVSVISKAVIFLVLFPFILVNSYMWIGSFLENNFFDTSKDSMLMNLAKQGAQFLSIAFNTYTICILLLFSMGYGVIYYHNGNSHRYRLFPHQTFVRIVGFFVTNLVVIYIYLLLLNGSKSDTPFLTGFDQLEPPSSGSAVLNLFAGLTGLFSITWFILIVYFYFKTKKTISHFPPNPNDEDSTQRVVLAFKRSILIILILPIIVMFIAGLITASRVVRGIADSLPDYPSGDTLNFDSVICMLALEKSMEVAVLPLLISNWIYFFSAVIGLFFIWIKDNNGLIIDRNVDDPIENADVSQFNISDEE

SEQ ID NO: 20837 - protein, 619 aa, Candida albicans
SMEKEIFQFDQKKKKNYSKAESTQFNPTQLNQTNQTNCYTTIMQLLFVSLSFYIGVVLANLARFDENSLSQVCSGMYSKQDWGGSFKPHIGLTLNQFDTLKYDPKNNNKDEKVNDKDISVSYIIFEYKDLVNIGADLGDGRYKFICDDYAINELKVCDEKQKGKFIVNKNVTNSTILTAQLTHLGHANINYPVNVTGYYCVSTFTQYENTVYNGQVNFQNAFGQLSASEIPKLPAYGILAICYAIALALFGFQFFKKRKENQILPLQRYLLAMLGFLTFDTVVVWSYYDLVNRIESPSSGFARFYMIFLALLNAAKITFSFFLLLCISLGYGVVKLKLDKKVMFGCKVLAGFNFIASFVYLFFNYYGGSSNALVSTDSIDTAASGSFLGLLPIIPIAIILSIYYVTILASIRKTTESLHKQRQIIKLNLYQNLFKIIFGSVILTFLGLTLSSFVYLSMSSTEMFEQHWKGSFFIYDFWPSVVFFIVFMAVAWLWRPTETSYMLAISSQVANDDENGEYQQGMELDTFSLMSHSDDDDDDEGGNGEHNPQRQVERDSFELPTTTNNKNKNIQPENPPQYDQLSTHEPHEAPSSTLFELGEDDEISDHEGDNRLKDEKHKE

SEQ ID NO: 20838 - protein, 149 aa, Candida albicans
SMEKEILQFDQKKKKLQQGRINPIQPNPTQPNQPNQTNCYTTIMQLLFVSLSFYIGVVLANLARFDENSLSQVCSGMYSKQDWGGSFKPHIGLTLNQFDTLKYDPKNNNKDEKVNDKDISVSYIIFEYKDLVNIGADLGDGRYKFICDD

SEQ ID NO: 20839 - protein, 588 aa, Candida albicans
TTFKDFQMTSPVSYANVAAIGTSPSPSVPAASSESKPTSKSTSVSSEPVEKEATKESTNEEDSTKESNKVFSTTESAPSPSKPSKKTLAPAPVPSKSVWGDVTAGVKELSVDDKKWPAPDKAPLLGEQPTSKPQSQKFIKPITNKWVPINAKVILPSSRNSSGSGGNHNQKHNRNRKKNTNNNQHHHQKSGSKKRDDKGEESANKESIKSSDANTSSANGSVTTDKKDSNAKDQTQAPASSADTTSTSTVSAEQQQQHQEQQQEEESFEQSTPQESQPHAQQQSQQPPQQRFNSNGQPKKRFNNNQQNGNYNGQYQKRYTNNNNQPHSQNQQAFNPQNVGFFQPQPYPPNFQYNVNNNNGNGGNRPYRNNNGGQYRNNRNNNNHNSNGNYRNGGYRHNNNSNNPMMTPIPFIPFPPHTLPGVPGIPAQPFPIPHQHLQQHLQHQQYPPQQIPPPISPKQDPQQALIQQIDYYFSLENLIKDLYLRKNMDNEGWVNLKLILDFKRVKIIINGLLNGLEKEKKEGEEKEETNVTTTTNDNYDKIILESIKSCQNLEINYGKEIDENNDVKLEDVKLRVKDNYQQWLVPDN

SEQ ID NO: 20840 - protein, 368 aa, Candida albicans
RTITQQDDNRTNLSSRNSKEQKWKNNSYYRNIQFTNLTDKPPNLTEDIEMISNNMKFISFSQSPILPPTRDTGTTSVPFPTSISDYNYKLANMANTNDNHKYTHLGKYENVTEEDDREILISVGKNTKIKKPKFPKSTKIKGGTGWYKYRISGDSPKEIPAYTTNAINTYPIPFEILPFEAQPFDIIPSPHDSITTSIGSALSFPNSAPPMVFYPQFGIPVYQIPIFNEGHPSSSLPISPISPLLQSQQSHSSPIFPPPPSSSSQLQQLSSAITVKKENIKHQIEYYFSTENLCKDTYLRSLFNKSDGSIQLSQLLSFNRMRMLTNNGKYTNLVLESIEEIPILELLLDENDKNNDSVRLVNWKSWII

SEQ ID NO: 20841 - protein, 111 aa, Candida albicans
QNSNQQTTTRNQKKKQGMRFIVSSFIFFISFLLSLITAETHTWYFKTSWVDANPDGVFPRKMIGFNDSWPLPTLRAKKGDRIQLYLINGFEDLNTTLHFHGIHPRRVEGPT

SEQ ID NO: 20842 - protein, 538 aa, Candida albicans
TMDEVVPRHGDHHNINIKYGYFIFALTIIQIIFFLQVKFIQIKRWNSTGRFSKFWSQLTNPPIWLMVTIWLLIVIFTGGHKISDFLEEYIISAKRYGRMAYCLIPLNIYLVLRPTNSPLLKPGYYLENMNLHKWTSRIIVFCSAIHAAGYIYKWVKEGTILNKPFRFLNLLGVIVFVFLVVLAIISVRTFRKKIYSTFYLIHNITAWSMVILITFHARPGVTIFAIISILLLGYQLYLRYYSSYLVNSLKVIDIPTSTLQIIKIPQPNKFPNWLPGSHIRLSYTILKFKSWTTATHPFTIVTIPEDSANNLTLIVKKPNQFVVYPLDSYLLTGPYPSLAPPFFTTANIVNIICGGSGISLGLPIYHHFKSINLTVPVKLVWTVRNQNDTFIMNQLDMTGVQVYVTSIGDTNSELQENQQHQAVPLFVIEEEEEEEGHGLLNNESENGIELQNMPESNEENSETITINSKNNKDNEERKEYFKFGRPKFDEVFAIDDPTTTHDLDNSWVIACGPDELISDAKRWSKDRGYRFYYEKYEM

SEQ ID NO: 20843 - protein, 378 aa, Candida albicans
RSRVIHFNSLHTISRLTPRSSKLLIIRPIIGKAQLSLSSSITTTKSRTTSPKMALTVQSCSQLPTGKLPEYIKSSKSRLYNIIWLSSSPPTNIYIAKKPGDASVREAMIEFINHLHQQYPSINVIVNQEVADELMHELKSTTTTTKQDSKSIQELMDPLTDHVIYTGKNEDIVDKTELMITLGGDGTILHGVSLFLNVVVPPILSFAMGTLGFLLPFDFKNYKQTFREVYEGRSKALHRNRLECHVIRKQIGKSNDDDAEQEEERTNIKKLKTNGETSIPMPTNGSSDDSKKIKEMIHAMNDVTIHRGSSPNLTSLDIYIDNEFFTTTFADGVIFATPTGSTAYSLSSGGSITHPSVPCVLLTPICPRSLSFRPWTLP

SEQ ID NO: 20844 - protein, 341 aa, Candida albicans
QSRKRFNPESPIANYTNGCKKLKYWNKKLTTKNPEIFDLVLTLGGDGTVLFASNLFQKIVPPILSFSLGSLGFLTNFEFSAFRTVLSKCFDSGVKANLRMRFTCRVHTDEGKLICEQQVLNELVVDRGPSPYVTHLELYGDGSLLTVAQADGLIIATPTGSTAYSLSAGGSLVHPGVSAISVTPICPHTLSFRPILLPDGMFLKVKVPLSSRATAWCSFDGKVRTELKKGYYVTIQASPFPLPTVMSSKTEYIDSVSRNLHWNIREQQKPFSSYLKPETRQSIAESERLDNLHISSEQDESNHEEPEITEDFDINYTDNERDSSSSTPSEESNEECANTTT

SEQ ID NO: 20845 - protein, 304 aa, Candida albicans
TQSRIFHAVVKTLYNDQIYNITPLWNVYGEIEGQNKDEVIIIGNHRDAWIKGGASDPNSGSAALLEIARALNELKQQNYKFKRTIILHSYDGEEYGLLGSTEQGEYYAEKYQRNVVAYLNLDDAVSGKHFKLSASPVLDEVLLAVAKELEYPEKGAASLYDHWLANGGRIKPLGSGSDYTVYLDHLGIPSVDLGFAGGKGDPVYHYHSNYDSYHWMKKFGDEGFVFHNLCAKYVLLLALQLSEREVIDFRLSIYSKKLQEYYNSTVSTIPKSWLNKTVKSSHTDWEEYNFINKATNGYYTDEIP

SEQ ID NO: 20846 - protein, 527 aa, Candida albicans
RRTSLARDDRNWHGIRLTKTDVKRHYLQMTGIGKSQNTLTTEEYIDSLLKNFTEINQQSSYNLMSQDNPKLTEFVISGFTDLKAFQTQVVKRKVNIGTPESSSVKLFDEQGKTIYIPSLLELDYSTPAYFALGKSGHFVGEYVFVNYGYPRDYSLLLDNNVEVKDKVVIIKSSYRDRNVTICEKVAIAEHHGAKAVLSYYDIESDYNSFGKDKVKLLKNAITRGSLLNNTKIPAIPISQDEIKPILNTFAFPGNGPYSNWEFAPTTTAKYKLQVDTRFANSEEPKEFTNIVGTIKGIINDADIVIGARRDSYTSSNPLSGHAVLLEIMRYYQKLVNVGWKPLRNIKFVSWDASYLNLLGVESFINDTTVFNPKRTIVAYISIDGDAVTGSKFAVDANAVFNSVLRRTAKSIPIPKESVSYTNKMGEHNIGDDDVYITDNKGNNNNNNNNDNDILIDNFVHNDFTTLYRYWWKQDKTSINNNLGLPIDSTESMIFQKHLATPIINVRFENDPEHDKAIYISSPRVQIP

SEQ ID NO: 20847 - protein, 91 aa, Candida albicans
NLPLWERIKLHFRIRHHNKLLQYFERNFLHQKGLHNRFWFRHIVYASGRYIGYAGQTLPGLNEAIEDGDFDRFVHWVNIFARTLKRINRHS

SEQ ID NO: 20848 - protein, 341 aa, Candida albicans
FLKFLFFLFNLSAMDEELQKHLEISRNTKYQWIACIFSLVIFLANGIVFYWIPRLLRDKRFVKTNRFKPYFAFVDIWQTINTPFSIKVGKKTHYFKPSLLALGACFILLNGKLCYIETDDLDYKPRIFIIGKRCARIALGQMPAMFLSVTKGDFITALTGLTYERAAFFHAWFATLMFLMMTAHVGIIGFYWAHPNYDIAPKYPKNVYGIIGYACFVFLVFGNVALIRRYAFEFLMVNHRVHSFIMLLMAFLHNDRAKAMVILAIHLLVLDKVLGRIYGIVHSLKSPTKGLSESEILDDETLRVSIPVKTSKTDPTPWYRLFLFKYGTCSSPTGAGRNRAW

SEQ ID NO: 20849 - protein, 725 aa, Candida albicans
  UNSURE (37),(61),(69),(91): Identity of amino acid sequences at the above locations are unknown.
GSQREVLPTFVQLKVKFHNWLFYELDFCLQLPPMQPXPGKYKRYGQLNQFIVVIFQIDNSXSFCRSPRXTTCLCFSENALATYAGCFAYDXRNKTEVVDYLVEYCEERGNVTIDKDWYEKSYQNFLEKAKTAQEIPNFNKTIPINVPFKLNEAQMQLYQEGYNHFMGNYDDSLYYGVGALGYWLLIMLFGAIFHWSKFLFPGLTKKLTFKPINLWREYVSMPATFRKKKAEEFRFLKIFDSLIPTRFESIVIFFYYVYTIVTHAINMEALDSDPVFYSKYKAQIRYCADRTGITATIVMPLVFLYAGRNNFLQWLTGWQYQTFVAYHRHTARVMFYLVVIHAVLFTVALADYYSTDVKETYLIWGIIATIAGGIILVQAMLFFRRRWYEIFLFIHIVLAALWVAGAWIHVEELGYIWFVYPTVAVWCFDRAVRIGRLIVFGFPKAQVTLMANETLKVVIPKPRHWKSVPGGHAFIHFIRPTCFWQNHPFTFVESPDGKSILVYCKVKGGITHSLYRYLSNNPGQTASIRVGVEGPYGEPTPAKYADTAVFVAGGNGIPGIYSEVTDMASRMPKETKTVIKLYWIIREYKSLEWFRDELMELANTNIETTVYVTKPELCCSSTDDGSDDAGSKKEYVAHEIKAEGDESSQGPESIRSRLSHVTFKEGRPCIKDMVETNLHESNGSVAFVSCGHPAMVDELRYFCSKNVDNSEKKRVDFYEQVQVWI

SEQ ID NO: 20850 - protein, 278 aa, Candida albicans
KVVVPKPDNWEAVPGGHAFIHFLRFDCFWQSHPFTYTTSKRDITLFIKVKIGVTTSLCRYMKSNENCSASIRVAIEGSYGESTPAKHADMAVFIAGGNGIPGIFAEALDINRHQELKHTVRLIWVVREYNSLLWFYEELMSLKDTQIETTIYITRPGILVNEDDFNKRLPRMGQNMENELQHLLQKSVPAAYNSEPVNSVGGIHSQIREELFHIKIIEGRPSIEKVIATCIEDSSGSACFVTCGHPAMVDDIRAAVANNIDNKEGKRVDYYEQLQVWA

SEQ ID NO: 20851 - protein, 599 aa, Candida albicans
GLEASIDQFLTNWQRSFFYGMAMSSYWGFVLLFGTISNWTQYLFPGLMTDLTGPFSNWWRKNLSLPATFGTKKTQEYTFWFKYLQGYIPSRLESIINSGFCLVVIIVLSINTYYSVGNEIIFTNYVAQLRYLANRTGINSTILMPFLVLFAGRNNILQWITRWNYGVFMMFHRFIGRMIFLFVVLHAVTFSIALGVDYYPLMSFPFMIWGTISTVAGGIIMVQASLYVRRRWYEVFLGLHILLALFFMIGGWVHISYLGYEWWVFVAIGLWGIDRIVRVLRMISFGFPEADITLMSDETLKIKIPRPDYWEPIPGGHIFITFLRKDCFWQSHPFTFAPSVENSNTIVLYTKVKQGVTRKLYNYLVTCPGRRAKITVGVEGPYGECCAAGKSQTAVFIAGGNGVPGMFSEIYDLAKRSTPDSQKRLRLYWTIREYRSIHWLYEELNELKKFHNVEVTVFVTKPDSNTYINELSSRVISGKCNSTENFDGATTATTSLYEKVSFDDKATIVVTNRDITSKYDPNSVKDAIIAQLSHVHFREGRPKINTIIKEEIEDAQGSICFVTCGHPAMVDDIRAEVVGTIGKYKEKRIDYYEQLIGWA

SEQ ID NO: 20852 - protein, 519 aa, Candida albicans
KGKKAEEQRLFKIVSHLILSRFDSMIVFGFYILVIVLHAINYPAIENEVRYKSQYLAHMKILGDRTAMVGIMSMPLIFLFAGRNNFLQWIIGLNYSTFVGYHRHLARIMFALFVIHAAAFSYLFGDNYNLVMSETNFIWAVVAIVCGGIIMFQALLYFRRKWYEVFLVAHIVLAIFWTVGLWYHVQYRGYVWLVLPSIAVWSFDRAVRLARLFAFGFPQADITLIADETLKVQVQKPKYWKSVPGGHAFIHFLDTKYFWQSHPFTFIEEELGSIIFFCKVKDGITRSLYNRLLSSPGKSTKVRVTVEGPYGEPTPARYADSAVFLAGGNGIPGIYSEVVDAAQGSSTGEKKNKFKLVWVVREWKSLFWFYQELVNLKDLDIDTTIYVTRPGIESFVEEYNNRFSESQAILSGDIHEKPKKDGVKVSVNKVDGEEEEEDSESDGMIDNIKLELDHIQFHEGRPNIEFLVDRFVEQSNGSIAFVACAHHSMVDEIRYYCAHKIDNPEKKRVDFYEQVQVWG

SEQ ID NO: 20853 - protein, 432 aa, Candida albicans
ILVKPTLHLLGFWIYVFFVLLKFVVIFIYFPQFDNLVCQPPHSFPKNMNSIAFILTSLLCIPIVVIAESLLLPKNSIQLAKSIFACKLNVHEEVKYCNTNSPEDYGCICSNKDAIMEFVGCYAYSQKDPHEAIDFFVEFCQEYGNTTVDMDSIYTAYENYTAKGYYNVSMPSSNHHNHSNNSNVFEPNLPKEKMANYTNSLKLAIDQYLVNWDNTFYYGAGILGYWALVILIAAISNWTRALFPGLMTDLTGPLSNWWRQNISLPATFGSKKSQSSTLYRFLDFYIPSRFESIVITGFVIVCIITLSINTYFAQGDELIHSSYDARLRYVANRTGTNSTMMLPLVILFAGRNNILQFITGWNYTTFLTFHRHIARMMFAFVVIHAGCFTIALGSSYGPVMKLPFMIWGTAATVIAGLMLLSYTTVAGRSRDC

SEQ ID NO: 20854 - protein, 549 aa, Candida albicans
VFFLIGFARKGLLAGNWKFELFLFPLAMLIPGKGGISNAFRKYITYPPLFKETHAHHKSIFGFFHAILPTRLESILVVAWFIMALIMNLTNYVHVKPNYIWPQKSNELGRKIADRTGQISMWLMPPLVLFAGRNNFMQWVSGWPYARFVYIHKWISRVVFMMSIAHGVGMTYNGKGIGKYYTRNAKPYVRWGYVALVAMSIMVFQGFSYFRRTNYEVFVGVHIILAVFAIAGTWIHTTEQGYQMWMYGAVAVWVFDRVVRIARLATFGLRSATVQLIANETVKVTVSRPGWWKPFPGCHAFIHFMRPTCFCQSHPFTIVDSVTESNTITLYIKVKGGMTHGLYQYLAQQPAQTAQIKVSIEGPYGNRMAIDRFENDVFIAGGNGIPGIYYEATDIAKRLGEKRNVKLYWVVRHYRSLEWFYQELLKLKDLPISTTVYVTQPNVGLADPITTDLTDDEEQQEHEQEKKSDTEESNDYVAQVKKNLSFIQFIETKPDFYQIVGEEIKQLTGPIAFASCAHGNMVDDVRKSVVDNLSNSNHRVELFEQMQNW

SEQ ID NO: 20855 - protein, 300 aa, Candida albicans
SAVLPCRGEELIYFGFPVAEVKLLTDDYSEEVVLRVTIPKPKYWKSIAGGHVFIHFLKPAYFWQSHPFTFVDSTVSDGHIVCYCKIKAGITRALYQMLMNTPDRCMPIRVGVEGPYGESTPARYADTCVFIAGGNGIPGIYSEIVDIANKQQLSKEEGCKRRLKLIWVIRKCNMLLWFHNELANLKNTNIEVTIYVTQATQKDLGDHDNDKFTKSSESLSKSANDTDSSLSTISHAKFIHGRPCLEDIIKQEISESNGSVAFVSCGHPAMVDEIRYQILQNINNDERKRVDFYDQLQIWA

SEQ ID NO: 20856 - protein, 274 aa, Candida albicans
AKPVEEIHKLPNYSQANFPVQLNESEIFIFKQSYEQFLGNYDKSVDYGWYLVLYWVVVIAVVSIGNWIKIIFPNLTKALTDPVSNWYRKHISTPATGSRNKTNELHLTKGLEMLVPSRLETIILTGMTVICLKMLIGDFQYVEGNPIFHSKINALLRFYAVRTGLLASALMPLLILFAGRNNFLQWVTRWDYSTFIMFHRWLSRIIVILFLVHSVCYSLYLKQHSKKPEAYIYWGFTAMLAGLIILVQGLLVLRRRWYEMFLILHIILAIVFIG

SEQ ID NO: 20857 - protein, 681 aa, Candida albicans
PRILVFGYFLSWYFLPTSVKAVKMPKFQLFGDITYFYTCNLQISLSVSYCATPYNATCLCANKNALATYAGCLAFDNRNTTTAVNYMMNYCEENGNVTVEKDWYEKSYQYFLSNAKTEKEIPNFNKTIPIDVPFKLDEAEMKLYERAYKQFLGNYDDSLYYGAGILGYWLLIMCIGAIVNWGKVMFPSLTKKLTSKPINLWRQYVSMPATFRKKKAEELRIFKFFDSLIPSRFESIVIFLFYIVVLMIHAMNMHYVDGDPVFENNKYNSQARNVADRTGITGTIMMPLVFLFSSRNNFLQWLTGWNYSTFVTYHRHIARVMFILIALHSILFTVLLRDDMSEFSETYMIWGVLATVSGGIILFQAMLFFRRSWYEIFSLIHILFAALYVAGTWIHVDELRYVWSVYPAVAVWCADRVVRIARLVIFGFPKARVSLLADDTIKVEILKPSYWKTIPGGHAFIHFLKPTYFWQSHPFTFGESPADTHIILFCKVKGGITHSLYQLLVRSPGQAITMRVGVEGPYGEPTPARYADTAVFIAGGNGIPGIYSEVMDMTRRMPNETKNAMKLYWIIRDYKSLEWFNDELTLLGNTNIETTIYVTKPDLSNLLTGDGSDDTSSKKESDSQDMNLESKESLQGVDLVKSRFSHITFKEGRPSIEDIVDLEIKESNGSVAFVAPGFSPR

SEQ ID NO: 20858 - protein, 699 aa, Candida albicans
  UNSURE (623),(626),(627),(628): Identity of amino acid sequences at the above locations are unknown.
YPFLVLSLPLSIICINTSKMKIQSLFYLLTILSTTLAIKVTHKKEVAYAACKSLLTQFAGSTSLGSPDPFCDVTNQPAMGSMAICLVENFKESSKDYYRPYLKTCSISEHKFFASYKNATNHILEISLSQDSNTTHPTRLSYDNVQLLFNQLYRQALNDNYSIWFGTVLLAYWGLVMLVASLNYWSHFLFPRFVKSLHGSISNFVRVHFILSPTVGNTHASSVKYLKVVQAYVPLRFESIIVLAWTVLCFVFCGINHYPTRPNLTSLVGNRAALLAGFCVPLLILFAGRNNFLQWLTGWSHARFLLFHRWQARVVFIMILIHVSAKTSVLIKFDSYPSIFLQNYVAWAMVAAISLGLLIGHSWQYFRNSSNEIFLIVHHILAALFIAGAWIHTRGADTPYAYYAATTIWLFDKLARLIRVSLFGVKKAKVELISDEVLKVIVPRPRWWKPFPGSYAYIYFLKPTTFWQSHPFTIIDSVDDANTLTFCIKIKGGITHGICQQLVKKTNQMDYFHVLIEGPYSRPHSGRHFENLVMLSTGTGIPGPYYTALDLIRKNDNSTKRIKFYWIIRDVKSINWFLEELCKLEGTIVETVIYICNTNTNFPFLKSQEMSKQFDSDAEKVSXFPXXXDYLKHRLQFVDFRYGRPSIREIVHQEVKEARNSIGFITCGAPQMVNHARMTIVDSLKHDTSKRVELFEDFQ

SEQ ID NO: 20859 - protein, 372 aa, Candida albicans
MIPPQIFGFMAYGSFSILKWASLKIIRQFVYDFFLVQHCILAFMMLFSTFIHNQGNRAVMLISVHGLVIDRVVSKVFAYLHAKKSPTKGRCTFRIIDDSMISVVIPVSEVGYTSKYWYTRFLPKYKTWKAGQHIYLNVGKIKFFQYHPFTISSLAESGEMKLLIRVERGFTRKLMRHLEQVDHDEVTIKAMFHGPYGARYQPLITFDTCLFFAAGSGGAFTFPVCLDLLNQIDRRDQEGDVLFRPKNQFIKFVWAIRKQDNIEWFEDSLKQFAGRCSVDIYITQETKEELPLQRKNLIIEITKSLTNDYNILYGRPQIQDIIQQHSQLLGANQSMAVTSCGSPSFTNSIKHHCQSARRVKGAPEVYCYTESF

SEQ ID NO: 20860 - protein, 406 aa, Candida albicans
EPWCKYFFFRFFFPRSHNIRHEFKFSCIIQNENTFGLLLNFQLGSNFVNQHIPILTEKPMSQYIGKTISLISNKGLRYVGLLENINADDATVALKSVRLFGTEGRMAAMGQPNLEVPPGVDVYDYVVFRGSDVKDLSVLDTPIDEVKPNIYRPPQQQQQQGATTGQYYSGPTSTSSQNGTPQTQTQAPATTSTTTASQSYGQTSSSAPTQASPAQAVPAQPVQTSAPEASTSYQQPTKTVKEEQATKTVADDQPADAQPGSAPQPTATNPSSNQLQQQQQQPRKGSKVEIPTEEFDFEQANAKFSKELEQERELEHAGYNKSSSFFDNISSSTDERTNMRWHEERNLNMDTFGEASLQRGRGRGRGRGGRGNWRGRGNYRGRGGNWRGGNSNRGRNSDYNTKPEWA

SEQ ID NO: 20861 - protein, 185 aa, Candida albicans
YYNTITSTNMTDGKFPTNIEPKYIPYSKDHASLTACANPIPLDLKSLFPNNTVVVTAVPGAFTPTCTEQHIPDYLKHLKDFKDKGVKKIIVLSANDPFVMAAWAKALGYTDEENYVIFATDPNASISKELGDGFVADLTLAGMGLRLQRYASIVVNGEITYLETEYSLGFLEISSAETILKRIHN

SEQ ID NO: 20862 - protein, 210 aa, Candida albicans
DEQPKKQKNTDAIYQPSFFNYLYSSMSFKEGSKFPAGVEFSYIPIQLDDLELINPLKCDVASQLKLDNLLTKLSTTDTPNLLIVSVPGAFTPTCTESHLPPYLENLAKLHDKKIGAIVVLATNDQFVVNAWGKVLIKAYVKTSGKFPEVIFASDGGFSEKYGLAGDRGGIIRNKRYAAVIDSKTKDVVYLGVETEKGVQSSGIDAVLAKL

SEQ ID NO: 20863 - protein, 245 aa, Candida albicans
IMPTLFHRYNEILRKYPFRSNMITTGIFFGLGDFFAQKLFPHKTIHKEVNDKGEIVETEQVTGYVFDRTARALIYGTFFFAPISVLWHGKTLPKIKNPLINIFKRKKMEQIPHEKKKLHFYDSVFRLGVDQLIFPGLIWIPLYNTVMVLLAQHENPFDVISNKLHNNWWTVLQASWTVWPGFQLFNLYFIPVHLRIVALNIWATGWNGFLSFVHNTKGHGKGSGRKIEELLDIEDDAQEITMVYD

SEQ ID NO: 20864 - protein, 224 aa, Candida albicans
HLYNHNYNYNLLDTLINQIHPFFFYLDLQMKYIFNRYNALLLRRPLITNMITTGLLVGGGDALAQFFFPNNDNNNLEQQPFDYLRNLRAIIYGSLIFAPIGDKWYKFLNTKVVWTRNAQKPQYQRSMSTLLRVMVDQLVFAPFIGIPLYYSSMTILENRQPFLDNIIDKFNTSWWITLKSNWLVWPLFQFFNFYLLPVQFRLLAVNIISIGWNTYLSYVMHSQK

SEQ ID NO: 20865 - protein, 160 aa, Candida albicans
FDNKLMDPILQFTTIIRNLGYAGYLTIDAIVFFKLLGIIDKKKYPNLGKYASRFWLLGLIAGLINSLRIIYSLNSYENDQKNTQDEKVKVKETETETETKADTVAINQKLYQAKRKLIWDLLDTFIALNSLDILHFTEGDVGLAGVITSLLGLQDLWKAT

SEQ ID NO: 20866 - protein, 182 aa, Candida albicans
INNILLHIKHTINPIMSDKEALKIFSRQPVSQDMVNFLVATTNSIIQVKPLKRNQHHRKLSSTSSTIISPYNHSISLTNFIKNLINYSNVQTPTLMATIVYLNKLRNLLPANAIWMETTRHRIFLSALIIAAKSLNDSSPLNKHWTKYTDGLLTLEEVNLAERELLNILNWKTNITNGRIEL

SEQ ID NO: 20867 - protein, 381 aa, Candida albicans
LLHINIFIMISSIDLQALKVFLNGPITHDMIHKIVVATLQVIPCEDTKSKTYTSSNNTIKQLPSLMTFLTKLVKYTNVYTGTLMATLIYLQKLKSRLPKNAHGLPCTRHRILLSCLILSSKFHNDSSPKNKHWAKYTDGLFNVKDINLMERQLIFLLNWDLKVTNEEMCQSLQSFLEPIKTDIIKQEKFQKYLQQKNQETKQMANAAVAVSISATTTPVTLSRSSTSTSTSSLVSSASSCSGRSSRYSSISPDHLSPMHYSNTNNNHYRQDSSSYISSIGSNNSPSSVYSISPKHNHKSIITNNYSHNNNNGGGGGGSGVRQIIDPIIELTAQKEELELKNFLSRKFGTTTTTTTTTTSTGNNNYGYGYHAAYGYNVANNF

SEQ ID NO: 20868 - protein, 235 aa, Candida albicans
RWSKTYEEYLDNLGKYNKYLLKPHLYSQPLTKPTPPPPFKPLIAISAGFDASQYENPQMQRHGINVPTSFYSTFTKDVVKLAKIHTNGKVLSFLEGGYSDGALSTGIFSHLIGLNNDDEFLWNHSWGSQQVMKELVKGCKKNWSPYKKPQSDITIWANEVIKLGRAMMPNAILPTNYVYDDQTKQLNRPINKMVKELMDSRGEAVEVSSPIRKDPEDDRKVMRHTRSYYKKVSNI

SEQ ID NO: 20869 - protein, 176 aa, Candida albicans
SWLSTSFERPQRLLASCIGVASAVSMFPFYYKVINSTKRGSVFSSHVRKIHGRNWPKKLFELCLESHEKLNNDELEVPEDWNVGDIYLTPKTINAIEGVIGTIESAVDSLFLKRKKENHNLAFVVIRPPGHHSHACLPSGFCLLNNVQIGIEYAFEQYGVTHCAILDIDLHHGDGS

SEQ ID NO: 20870 - protein, 441 aa, Candida albicans
SQPFAFSFSVTNLNFISTMPTEPIRYVTKVDLTKPGDQQPHLHNRWHPDIPFAETIKPGETVKIECFDWTGNQIKNNDTADDILNVDLSRIHYLSGPFNIEGAEPGDALVVEIKDVQPLERQPWGYCGIFHKKNGGGFLDKFYPEAAKAIFDLEGIHVTSRHILHFKFTGLIHPGIMGTAPSAEVLKEWNSREIGLINDIQHQHETNVANGPLETNSHPGSATGTLALKIAKEGARTIPGRPENGGNCDIKNLSRGSKCYLPVYVDGAKLSVGDLHFSQGDGEISFCGAIEMPGVITIKVSIIKGGIKKLSLKSPIFIPGDVQNHYGPSRYLTFEGFSVDEAGKQQYLCATTAYRQACIRAIEYLRKFGYNDYQIYLLLSSAPIEGHIAGIVDVPNACTTLGIPMDIFDFDISPEGNFEEKDMKNCAFVEGAKHSVTYDYK

SEQ ID NO: 20871 - protein, 71 aa, Candida albicans
FANLAALPTGKFALRALGQSLAREFGPKGSHVSHVIIDGVIDIPRTKAWTFEHEDAKLDPDAVRCFFLVWN

SEQ ID NO: 20872 - protein, 74 aa, Candida albicans
LLIMILSFFKVFNIFLTSVTFKFQFSRAFIFNLISLFSLSNIDTKNGDITRRLQFLTSKDFNDSGNLIGFTFWS

SEQ ID NO: 20873 - protein, 139 aa, Candida albicans
TSQHEQYPFVGHVCMCLGIPPPLSIVHVKTWLKKTTTTTTKKIFLLPSLSTMSSLSTTAIQSLDEASRKEIMQFVESEQSKSKVQLSIHNFTDMCFKKCNKDKPITSATLDGQEEACLKNCLNRFLDTNIKVVEALQGR

SEQ ID NO: 20874 - protein, 189 aa, Candida albicans
CSRKLVNVDMMMLLLFSDLLWFFFFACRCVCVNFLQKRVSFLICSPPFKNCAKYGKRFHLHLPPLTIYHQKLLVVVEKKKETKIKAIPPASLKHTVIYIDMGNIMSVSFAPECTPAKNAYDDCFNKWYTEKFLKGKSMENECTEFWDTYITCINANLAKQGIKPMLDKAREDQPFDHQEIKESLNNEKK

SEQ ID NO: 20875 - protein, 812 aa, Candida albicans
IACADVRSPVVKTPPRLSVRKKYNATEMDRHNRNYEKKFSKKLKELNVKRQTEHTQPTTRKLVKLSEADIEKSTTTRIMLLLETPTPQSFEDILDLIDVPQTILNTDQSRQVISVCKKYLAETVPELSTTTPDIMGPMSASLCIATVMNKNRFDLKFRVDDTFSEVAQLVYWFVHTMLTPEHIPRMEGPILYICDLLKKLSFMSTIVLCDEESLTKFEISAIHILFEELDPEFLLKHATATFLADLYHLSYIQRKFLLNELTTNFLRLPTKKSEARNYRTHRGFNILVFTAVAVKFAREESDANVLARELVLRVTSNFDATAKTLLELLVEDLIHLLPFGEWAASAALLYGLATTMLAEMKNPAVEVFFLELLGTISSSVHEVKHLFHPNFLKPAFEECLEYGSDTDLNYVTHAVYDKHPRSRKRYIELLVLDLDKFCNAYLTLLGKCLNSPKTKLKTKAVKVLSVLSDKQPNLLNSKVLQLALSARLCDDATLVRDAVYELIGKYIKAHPNEADNFYNSLCNALSDEGVSVRKKAIRLTRDIYPMFSETSRISIATKMLKRLNDEEDNIRKEAASMLVDCWIRKHLVLEMITLAMSHHKTLEGLETFLESYVFPEKELQPHLKQLVETLLDMQTEGALLLLSVCSSGKPDLIGQDLLIALQPFLTDANNVTQKSYQYGLKVLRCALPHITSLRPDFIDPLQEFLFAKLTKMTKKELHEAVPSLWQLCKIKQDFAKLVNAVISTMKMIWKNTEPHRLAKLIQLLACLEKHCDLERFREMFAKANLGLKTNESVVSLSVKVLTSRLESQRPEG

SEQ ID NO: 20876 - protein, 118 aa, Candida albicans
KNQFHYKAMAPAKKNQLSTENALASVQVYMQQQYRPYSVSDILLNMHNVLTKPKLITILDTLVADQQLVCKTIGKASYYVSKKQECVSDNTSKTETSECLNQQIKDLKQEICHLKLSM

SEQ ID NO: 20877 - protein, 259 aa, Candida albicans
NIMTIESNLESNRSEELDNLLTQLKPRLLAYIDEADPKSSNYKPESLGTFHEPKFLKQQFIDPDNDLDKPCSEEELFETIDKVLKFSVNTWNPGFLDKLYASNNPIGVISDILLSILNTNSHVYTVSPVLSVLENYIGKKYAQLFFHNETCGGLTFSGGSWSNITSLQIARSLKYPDTKVKGNGNYKFALYTSKHCHYSVEKGAILLGLGSENVFKVDVDENGVMDVDSLKQVIEKTKKEGYTPLYINATSSPRGRNPR

SEQ ID NO: 20878 - protein, 952 aa, Candida albicans
VDSCYSIIGKLFTYYYSGLFVFEQELRTLDKQYDFKKFRSTKDLTHQIEKTLTNFDYSLLHDVDANHTFFKMFIQCSRYSELNKILKTISNINLRDIKNILKDPQYNDYFEAAVQNCIKMEDKDFEMVDQWNEGGGLYYFLTLMKMIPATHDYYKLAPLLFALSKDKGIFASAAGELLRILTNEEVRGPINVASMVDDKQKFPIYAITKNNFTNYVFSFLKLIDFPWESARDTENWDTENLGIENNVFGKGTMYDYLTTNQYFIRRIFSDPNITIKYMELRAKPSFFCLPKDHEISKDVAELKKLRESLQTSFASFKTIDRLLESISKLGTLGTDKNLILSHLLDASRYFGNNTFVLDDVIDEEVKNGQPVAKHDSYSQMPDWLHLESHVPEINFLKLKVGNFSDKNAVMTVIENLTNEIIAEENAHPEINANSFLKLRSKLIEFSINNVNDCLEVLDTVVVNQDAFEKFEQKLGDKKIPAVYIQIPDDFPLHEFVEELSELREVLGKPFSETNVDEILNQVQKFLEKQDLIAIDKTVIWRKLYRNLAMLFKHNNNNTFVLDNVISSAQEFKKFETNHLKNDQNQTAIGSQGQLLVGTAYEVLGEFLRDSGILYKPDVHNISASEFDKLIDQYADKLDKSSSTYLFRKNILDQLKQWNSQIEFYPPFLVCIYGTNYTDELPFASTQLEMFYDDLVKSLKDVAEEQKAAEAENIVAPVDTKLAIDQFKKDVKDKVKYNDSGKLFADLDKKNSAADFEAIKLAVHSAFEEPHEHVVITTNEEVAKHKKELNRVSGELPLKTEPHTVDTSKLEKYLQEAKKLEESKKREKEAFEWSKQTKAPSRAYSFVRSILATSGLVLLSLIGIDFYMKETDKSSSKTITDYQNEENNKLSRTSTTTGPFTVSTISGGTPDVPVIFGKEKIKLVFNWDSTENVSVNDDDNKQMSWWQKLFWKK

SEQ ID NO: 20879 - protein, 349 aa, Candida albicans
RKNQNIQQTTTSKKKKKTYVESYSLQPTTVKLYLMSEDSSPPPPLPARKSLDSISIETEISKKLPDLPSAANANQRISFDLNDSVSQISAVRQWEIYTSLQLNETSDIFVNNAIGQNTIRTKLNELKDDHTKFWIDMNDYSSLILLPKRINKLEEEILTGIPLNIRYLVYLKTLLVRQKLNSRETFSSLLTKSRQLRDEYIESLAVDSRVREILIVFNYYVNEITNSKFEIESDENLELMQLPISRFIINVCILLGTFPEASQEDVLYLLLKFNKLYTCLNKDEFFYKVSRSLEEGLADIFKHISVQGINLNSLFRSILVQLFSSELLDEEVRLRVSSHRHWTDPKLDV

SEQ ID NO: 20880 - protein, 197 aa, Candida albicans
  UNSURE (193): Identity of amino acid sequences at the above locations are unknown.
RGCFQPRGEDNQTVPALLNDPQYNVGSLTQISRSKHYIMRPLPKLIYTLYRLFSFNYFTMYFFRLMFIFFSELKVPLFKGEGIISNYVRKLTTEASVLYIKEVAPEKYHDKLIPDYKIGCKRLIFDYNYVPSLKDPRIDIKTERIDKVVEDGILLESGEHIEADIIVACTGYNLSKSHFNFEIVGRKSADITXLWKE

SEQ ID NO: 20881 - protein, 119 aa, Candida albicans
GEDWTIGGTNSITGHASVVMGIENGVDYFLKTAKPVFQGKAKSVQVKDEAYDNWLTTLQKEINKSVFGTPFGGCVSWYSGAKVNSISYPWSQLHYWWKTQFPTYRDLNYEPLDENKKRR

SEQ ID NO: 20882 - protein, 254 aa, Candida albicans
PTPMSTITLTRESHKNPSKFRINHQDELDILGPNRKDRYAINDKLPTITTSSKLAIIGAGFGGMAGAIKTMEKYDEHDIQIFERHDNFGGTWYANTYPGCASDIPALWYSFSFALTSNWSRIQPPQYEMEEYILRVAEKFKLKEKTRFQTEINKVEWDDVNGEWTLYAHDVKTGQRIIHKSKLLLACQGGLVHPLHFDAKGLENFKGPYMHSALWDHSVDFRGKKVVVIGNGCSANQTVPALLSLHPRGLEGPA

SEQ ID NO: 20883 - protein, 343 aa, Candida albicans
FGGTWYANTYPGCASDIPAFWYSFSFALTSNWSRIQPPQYEMEEYLLRIAEQYKLKEKTRFQTEINKVEWDDVSGEWTLFAHDVKTGQRILHKSKLLLACQGGLVHPIHFDAKGLENFKGHYMHSALWDHSVDFKGKKVVVIGNGCSANQTVLALLNNPDYSVGSLTQISRSKHYIMSPLPKMIYTLYRLFSLNYFTMYFFRLMFIIFSELRVPLFKGEGIISNYVRKVTTEASVLYIKEVAPEKYHDKLIPDYKIGCKRLIFDYSYVPSLNDPRIDIKTEGVARVVEDGVILESGEHIEADIIVACTGYNFTKSYFNFEILGRNATSITRLHTQPAEGPLIS

SEQ ID NO: 20884 - protein, 327 aa, Candida albicans
  UNSURE (28),(51): Identity of amino acid sequences at the above locations are unknown.
ISIPYTHKMSTKSANSTAVNSFNANHSXYDVFRPSFTPVLVNTFLVHLGLXTKNPDDTFTFDISKHILEIAAGTGKFTRNLVDNGWTDNLAVLEPSKGMLETFNKNFPQIKNQILGSSYKIPLEDNSIDAVIIAQGFHWFADLDSLKEIYRVLKPQGKLGLIWNFDYASPSQDSSVADSEYFNAGTQYYNTLNFNLDTNEKVFEQYFDNQQWNKAATKFIYGFDVNVPQYRHGKWRQVLKDNPYFSSEETNLFALYDLIVAKDDAWKYWETRSYITEKSDDEKQRIKQNFNELVEKNLDDSSYSDKDKQLIIKPMATHAVVSQKKSS

SEQ ID NO: 20885 - protein, 824 aa, Candida albicans
IFRRLCFLQVTNNNFITFYTLFKTTFNLNMNFILTIIFLISNYLLVVESVAIKNLYSYLSLHKKDNAGDSSNDVFKNVDLLYGTDKNGHMFPGITQPFGMAKVGVDVNDPGFGDSYSGYAPNGVITGISMMHEIGTGGAPQYGVVCQLPYTDETLAGDQELSLHRTKKDSATIGQYFVNTPNIDIEFTSGERSGLFKYNFHSGDKANVLVNASHHLSAPKQPQWTQHFVKGSIKTKNNNGYIGKTTIKGGWGDQSDWTIYFCGEFNADFNQVTSFANGEISYNSNQANSSKVDDSMGLSFQFNKQDLKNNELISRVGISFISTDKACANIEDENFDFDSMVQQNQQQWKNEVFQKFEIQHDNQTVVDQFYTNLYGIHLLPSNRTGENPNWDNQDNIVYYDDFFTIWDTFRTLNPLINIINPTRGAEIVQSLANTYKNDGYAPDARSANQNGRVQGGTNSDIVIADAYVKNVANNVDWKLAYASMVKNAEVAPPYWYDLYSPTDSSKQGRGALPDWLKYGYITRNYTRSVSRTVEYAYDDYAVSVLAKEFGSSDDHDKYLKRSANWQNIWNFEASTNHYHYTGFLQPKNADGSFNYTSYDPLNCYGCYWGNDEYEAKPIEYGWSMLYDMETLIEFINHNNNDKDNDASLVIQRLDDMYLLRGHEIIVDVGNVTSFATPYLFNFINQQYRSVELVRYIMNTYFKTGESGLPGNSDAGSMLSWVIFAMMGIYPIPATTTYLITSPFVSSLTINLENGAQFKVKANNLSEKNIYVQSLKINGKKWNKNWVDHNTLFGKNGGAIEFELGENPVVWETGERPPSPGHYKL

SEQ ID NO: 20886 - protein, 79 aa, Candida albicans
NLMNFQITRVASTIRCRSIVFIMRACLFNDWVNNFGNLDFTQELTMWNSNSHQQYNNRSSNSKVNTSFNGNENSQDNSN

SEQ ID NO: 20887 - protein, 351 aa, Candida albicans
  UNSURE (351): Identity of amino acid sequences at the above locations are unknown.
FPIIAMSSALLPISCISCRKRKIKCNRIKPCDQCIKRHLPCEFPEKFRNIKIQEDEIKPELDGEPKLEPEDDMNSIYDYTRKPSENLSISTSGSASILSSAPSKSTDSTDSIPTSTDSATNSDSREKCMVTKNHSTGKISHSSPSAIPITVGSLNNSIIPSSKNLIDSDAPNQDSDNLTLLRDDYDIMKAANTQLLSSNRLLKRQLEELQQSTLSHFRRSDMRNCHDNAHKNGSCSCNKTTKTIDNGNHNRGDANANLLPNLPRSGDKRANTSDSFSDESPNKKEKVGVFGYSKSSFPKDSASQNQGIYSNNQFNEDNSSSPPKETSTTSTDSSSSGGEIGQTPTFQPLFX

SEQ ID NO: 20888 - protein, 226 aa, Candida albicans
IKGNINNYRDSTQNSDNLFGHSFINTSPVDKKSLELIKKYQANTSTTAEGKKKSNKVQELIGLIRHFASQFFGNFQKTIGDANQLQEKFAKLFNFKHYLQIYQNYKDKFLQTYIGIFFRITIKRDNESRIINPINFCNSIIAISNLLQYSIEEDKYDIISNDDVCKVLNLLEKPIRATTNYIDYLPASVYVPQNSQPKKHSCLMGKLHDLSMHEFYEICIRFLHHG

SEQ ID NO: 20889 - protein, 214 aa, Candida albicans
KLSVVYFEIDATDDQLIEYQDRLEIATTITAMAIQENISEKSPFAIIGCSDETIQVVSLQEHNCLEIKSLQALSANSSSLKMLKLSGKETHVHIGMENGVYARIKIDTINGNLSNSRVKYIGSKPVSLSVIKFSNEIEGILAISSAPWISYLYRDSFKITPLLEIDITNGSSFISEDIGGERIVGIKDNNLIIFSVGKKDSVFDPLQDLTIATT

SEQ ID NO: 20890 - protein, 243 aa, Candida albicans
LQKKKCIINYYELDQGLNHVVKKKPNSSNLDPLPNDVNYLIPLPGHIGGMVVCGTNWCFYDKLDGPRIYLPLPRRNGQTQDSIIVNHVTHVLKKKKFFILLQNALGDLFKLTVDYDFDKEIIKNISITYFDTIPPALSLNIFKNGFLFANVLNNDKLLYQFEKLGDDLTESELVINSSDYESVNSVRESVTSFKLKGLDNLALIDVLETLSPITDSKIIDSKLVTLSSHSYVKSITHGVPQLH

SEQ ID NO: 20891 - protein, 198 aa, Candida albicans
QFVPFADDVMKRQITSIMNLDIDTLIGGDKFGNIFVTRIDEDISKQADDDWTILKTQDGILNSCPYKLQNLIEFHIGDIITSFNLGCLNLAGTESVIYTGLQGTIGLLIPLVSKSEVELLFNLQLYMQQSQNNLVGKDHLKLRSYYNPIKNVIDGDLLERFLEFDISLKIEISRKLNKSVNDTETKLILNQPWPIHLD

SEQ ID NO: 20892 - protein, 70 aa, Candida albicans
GSRRSQSKHYSCLPKNMTVDKNKLDELVKSWLSIDMNPESRHEIEQLHISGNYEQLDRKLSKRIAFGTAW

SEQ ID NO: 20893 - protein, 302 aa, Candida albicans
QMVGLTKEQLSTFEREGMLCIPDFLTPEQTAKLLAESKTLLSNCDLSTHPKTTFKTADDDHIGDKYFFESSDKVSFFFDTDAFDKDGNLQVDLSKAINKIGHGLHIHNQLFQETTFDKKVQDIARSLEFKDPRVLQSMCIFKQPTTKTSNNSRDNAVPPHTDATFLYTDPQTAIGFWYALEDCTLDNGCLAYIAGSHKKYPVTKRFVRVEGGAKGCNFKYLNDKEQEPVIEEEEYKYVPCKAGSLILIHNSVLHKSEKNASDKSRYAYAFHVIDGTAQYDQLNWLQVPYTGGTNFSKLYNKE

SEQ ID NO: 20894 - protein, 94 aa, Candida albicans
QVTIIIMANSKQILLLYKQLLEKAYKFDNYNFKEYSKRKIVETFKANKSLTNENEINQFYNEGINQLALLYRQTTISQLYTFDKLVVEPLKKHQ

SEQ ID NO: 20895 - protein, 695 aa, Candida albicans
KQRTKNNQVAKMAVNGNFNDCINSFSDEVQTTVEDILQNSDRDYLMEIPDDSLFNNGNIQFKNLLDDIDLDYKLSPDDNATDQVKSQIENHNTNIANKCKEFVVTSTFLNVINSRVQVFVESDMAEEAKFFNAIALILDFEVSLFLNVDPIFKQVYYDSILKITKQLFLISTAVIEKFWSYLETRVPIILKKLYQNTPSERMSLLEMCNHLTDNLIVKNKEGQRDSYKKDSFNDQFQARVRFFITSILNFEDNTGLNKYFHVSDRASSSIQTKDPYLEDLLEIQKLFNNPLQYLKRENQKKLRVLVGKVEKVSKELLIQENIFRSSHPSWDQFLILPPKSEAEKDYLTEKFSKSSYVPENYFISLFQENDRKQQAEDAQMLNEIMRKPVARMQCIQLIYVVAHFFSELSVKNKNQFLSSIHAPPNIKHFVDGVLPDDIVSSFGNVKKDIMHTLRATDPHWLFLLQHLTISEKNWWSWLTYGKNSKTNKSFFFDKNLTSDDIHNTEDTFKSIYPYKDKKYFNTFVTPQVTRKMKIQRGLSQIERADVFSINDSKFEIDTIDNELSQTTDVNNRNELLEKKSLLTWRVLREQRSSDWLKATQALRAKAVSDQERNADNETKEDDSGGIAKSQKRTLTESVDDDSPEEKKIRLDEQINSENSDDVSEKDPQNHVISEANDASADSDGENHDAVDVDIK

SEQ ID NO: 20896 - protein, 738 aa, Candida albicans
  UNSURE (266): Identity of amino acid sequences at the above locations are unknown.
QFYIRMGDSEQFPSPFNINPIYPNKRHAKLSSTDTKTTPSPTPQSHLTPLPALPNNTNGKSISNSNGNITTNSFTTSINNTEIHLNNKFKAKDAEDVIDWIDSLKSRYEQLIIHQKNELNEITNDELMRKQKQATVDKYLSMHFDQDYEKLGHLLEVQDSHHPQKDSQKEEIIDSNDEDEQEDEQEDEQEQYDEDNEIIEILSLEPEEEVSEQPTTQEHYGQFHEELQYPQMTHSYNNNFQMSGIDYGTNYNQNIEYDEEEEEDVXEDEGDEFDGFIDEQAHEVQGSSNYEDEEDEDEIIDEGDQFEEEEEEDDEQYSYGTGAQYQQRGYGITNVPGYTIVNGRPRLSDNLGYGHVETFDNNDSEEEEEEDTNQEELSEDEIDDEANYFAQNTHQGKPVETIDLGNTEDESRDSNESGSADEDLESDLSNENENHLESENLDDSVVEGYEAGHEEEEGEREGAGIGLEFYSNNELLDFAATALLQGKIHEHKSKHSQSGYIADSEFTDTNVPVLHSPNTETEEGKQSQLNNHNNNISTVHSSKKSNDSSTRISYRSEGLAPVPDPFYAHELSNEKMVAVVNDFDENRSEGSLADESQFESMKPKVTLPNQDDPINDNGQHHKENQHKDNESVYSSSDEINPPIPIFKTIEEEEPEIVLQKLKETEKKYNIKINAVEELERELHLPIEHANDDSLVPAVESHEDKIVQSNPALDEHVEDEEEDREQKYEPTIQYEYSEI

SEQ ID NO: 20897 - protein, 309 aa, Candida albicans
PSSKINRKVAFEDGDIDTESQQQENPSSEEDTQGDRNVQSSTSSSPPNSSSTDSALPASDSSDIGGTNKSKTTSHGNNKNINAKKRIITNSSASSTKGTKRHTNNDGGGGVNGNHSDDNKDLTLTIDKPLLFTRGSTGTANSGTTSSHSDKKILYPTPTTTTTTTTTTDHTTVLDDISHLRVLVAEDNLVNQEVISRMLKQEGITNLTMACNGAKAIDFVKESIENNENFDLIFMDVQMPEVDGLKATKMIRKNLQYNKPIIALTAFADESNVKECLNSGMSGFITKPISKTNIKKVLVEFLSNEVVTS

SEQ ID NO: 20898 - protein, 616 aa, Candida albicans
TMRRLKIGIRPQLIIIVCFASLFSLLILGIVTGIYFSANLKNLRLERLLVISQLKRTQVQQAIQYIAYQVMTVSEVDSLTVPLSNYRAGNNSKAVFLEAQNYLQQYVLTTDSFTAARLYDLDLQVVASSFDNMTLISESAQDVVYPLQPNRSMPPVLGTPLGLYFTGPIANNSDNFNSRYFMGITVPVLSNSSIILLQPSISGYLTIVAAAESIRSALNSTSEDDYQAMAVQPVYGDPQKGIDNLLQNAYNGDNEVIGFKLVFPVENSLLEAGTIYNINSSSSMKTALASNSGTATGVKSFFGKKVAIGFSRISVQDNLNWSIVIVQSNSVFNGPANKLRKITIGVVIGIGAFMCFVTFPLAVWFIRPITKLKEATEAITKYKKEKLNSVNSNSPTSGSGSGSGSGSGSRANSDSSADQSLLLDTGKRNSINSSSFSSSYSTGIRLPARIPRSKKIFKDELTELSEAFNIMTEELDKQYTHLEDRVKLRTKELEASKIQAEAANEAKTVFIANISHELRTPLNGILGMTSIAMEEEDPNVIHDSLKLIHRSGELLLHILTELLTYSKNTLNRSKLEKSNFQILEIVYQVRSIFNKLAHDQRVNFKILVKPKYVPKN

SEQ ID NO: 20899 - protein, 61 aa, Candida albicans
LSNSLKFTPVDGSISVSFKLLGEYDHERSKKWDNKKVCILNDSISNTVTVAPPKPPSEYLT

SEQ ID NO: 20900 - protein, 339 aa, Candida albicans
LGRSADQARVLPAPWRRPIFESQFKSKPLPALPVDAKPQVSGKIDENDVNDEDPSGGSIKDDDSEDTINEKQGILSSPSSSSSSNEKQENLPRSNDSTTVTVTRPRHNMMPLAQDFKSYPTFDKKPEYDSNMSNNEIVKNNRVYRIRNMYQPKVWVIQIEVTDTGPGIEPALQEKVFEPFVQGDQTLSRSYGGTGLGLSICRQLATMMHGTLTLKSTIGKGSTFTLTLPLPQTGEIMVPPEDMAEFCEDEFNPAAKLIEKLHLKMVILILSHNNKKIPHQKKIRKGIETFNHPLHRHHQILHPLIQHYLLQTRLILEVPINLKQQVMATIKISMQRNES

SEQ ID NO: 20901 - protein, 242 aa, Candida albicans
TRGEDPCSITDLASAIIPALESRSISQNSDESVRYKILLAEDNLVNQKLAVRILEKQGHLVEVVENGLEAYEAIKRNKYDVVLMDVQMPVMGGFEATENIRQWEKKSNPIDSLTFRTPIIALTAHAMLGDREKSLAKGMDDYVSKPLKPKLLMQTINKCIHNINQLKELSRNSRGSDFAKKMTRNTPGSTTRQGSDEGSVEDMIGDTPRQGTVEGGGTSSRPVQRRSATEGSITTISEQIDR

SEQ ID NO: 20902 - protein, 93 aa, Candida albicans
TRFFQPLGEYVADVEGAWKQVTENVNLMATNLTNQVRSIATVTTAVAHGDLSQKIDVHAQGRDFTIEKYNQQDGGLFAVVCIRSVESGTRCWY

SEQ ID NO: 20903 - protein, 398 aa, Candida albicans
  UNSURE (313),(348),(350): Identity of amino acid sequences at the above locations are unknown.
DLLLQLLLQLRMVICRKRLMFMPRGEILQLKNTINKMVDSLQLFASEVSKVAQDVGINGKLGIQAQVSDVDGLWKEITSNVNTMASNLTSQVRAFAQITAAATDGDFTRFITVEALGEMDALKTKINQMVFNLRESLQRNTAAREAAELANSAKSEFLANMSHEIRTPLNGIIGMTQLSLDTELTQYQREMLSIVHNLANSLLTIIDDILDISKIEANRMTVEQIDFSLRGTVFGALKTLAVKAIEKNLDLTYQCDSSFPDNLIGDSFRLRQVILNLAGNAIKFTKEGKVSVSVKKSDKMVLDSKLLLKVCVXDTGIGIEKDKLGLIFDTFCQADGSTTRKCGGTGLXLXISKQLIHLMGGEIWVTSEYGSGSNFYFTVCVSPSNNKYTRTNEQLLPI

SEQ ID NO: 20904 - protein, 232 aa, Candida albicans
  UNSURE (21),(26),(228): Identity of amino acid sequences at the above locations are unknown.
DFLCWSCVVAIYKAPPYINKXFLFSXVYLEFLLLSPMNPTKKPRLSPMQPSVFEILNDPELYSQHCHSLRETLLDHFNHQATLIDTYEHELEKSKNANKAFQQALSEIGTVVISVAMGDLSKKVEIHTVENDPEILKVKITINTMMDQLQTFANEVTKVATEVANGELGGQAKNDGSVGIWRSLTDNVNIMALNLTNQVREIADVTRAVAKGDLSRNIYVHGSHSRKXGHRS

SEQ ID NO: 20905 - protein, 64 aa, Candida albicans
RLNEDGGLQQYLLVKNLRTLLTIPESVSFEQSAITTDSVLTPFNAIAKIRHLLTPTSKILLQGC

SEQ ID NO: 20906 - protein, 381 aa, Candida albicans
NFQQFFQIKHKFLESRLFIVLVMSLLLKRLSPIKQSYSKVLAIRTMSIPSTQYGFFYNKASGLNLKKDLPVNKPGAGQLLLKVDAVGLCHSDLHVLYEGLDCGDNYVMGHEIAGTVAELGEEVSEFAVGDRVACVGPNGCGLCKHCLTGNDNVCTKSFLDWFGLGYNGGYEQFLLVKRPRNLVKIPDNVTSEEAAAITDAVLTPYHAIKSAGVGPASNILIIGAGGLGGNAIQVAKAFGAKVTVLDKKDKARDQAKAFGADQVYSELPDSVLPGSFSACFDFVSVQATYDLCQKYCEPKGTIVPVGLGATSLNINLADLDLREITVKGSFWGTLMDLREAFELAAQGKVKPNVAHAPLSELPKYMEKLRAGGYEGRVVFNP

SEQ ID NO: 20907 - protein, 365 aa, Candida albicans
SDYLYDQTLSPQGFDNIRENFTIHKTIASLYEDNSSVVSQESTDDTKTTLSLETCESFSLNNASYLTNINFVQNHVQYLSQNVLGNRTSNSLPPSSSSQIDFDASNLTPDSIPGYILNKKLGSVHQLTDLVYNAIKIHQNQEYNCCTKASASQNPTNLNSKVIVRLSPNIFQNLSLSRFLNEWYILSGKHSSKEHQIWSNESLTNEYVQDKTIPTFDKESARFRPTLPINIPGILYPQEIINFCVNSHDYPLEHPSQSTDQKRFAMVYQDNDYKTFKELSMFTLHELQTRQGSYSSNESRRKSSSGFNIGVNATTTEAGSLESFSNLMQNHHLGATSTNGDPFHSKLANFEYRVFTRRRKHNVGN

SEQ ID NO: 20908 - protein, 1000 aa, Candida albicans
  UNSURE (977),(992),(994): Identity of amino acid sequences at the above locations are unknown.
FHLIVNVSKIFFSCMNGESFKMFSTFKCKSYLTGDPQMPEMDNFLYDSEMLLAGHSELNEFMRKYQSFNQTSVGKFCYYLIVLLVMSREHRFDEAADLVLKVLEDLLEKLPVSFLHHQYYLICGKVFAYHQTKTPESEEQVERILARQFERYELWALTNKPTLLPRYLLLSTYKQIRENHVDKLEILDSFEEALQTAHKFHNVYDMCWINLECARWLISINQKRHRISRMVKQGLKILRSLELNNHLRLAEIEFDEYIEDEDHRNKWAGLTNNPTLDTVTTWQQQNMPDKVSPCNDKQLVHGKQFGKKEFDSHLLRLHFDGQYTGLDLNSAIRECLAISEALDENSILTKLMASAIKYSGATYGVIVTKKNQETPFLRTIGSQHNIHTLNNMPISDDICPAQLIRHVLHTGETVNKAHDHIGFANKFENEYFQTTDKKYSVVCLPLKSLLGLFGALYLEGSDGDFGHEDLFNERKCDLLQLFCTQAAVALGKERLLLQMELAKMAAEDATDEKASFLANMSHEIRTPFNSLLSFAIFLLDTKLDSTQREYVEAIQSSAMITLNIIDGILAFSKIEHGSFTLENAPFSLNDCIETGIQVSGETILNDQIELVFCNNCPEIEFVVGDLTRFRQIVINLVGNAIKFTTKGHVLISCDSRKITDDRFEINVSVEDSGIGISKKSQNKVFGAFSQVDGSARREYGGSGLGLAISKKLTELMGGTIRFESEEGIGTTFYVSVIMDAKEYSSPPFSLNKKCLIYSQHCLTAKSISNMLNYFGSTVKVTNQKSEFSTSVQANDIIFVDRGMEPDVSCKTKVIPIDPKPFKRNKLISILKEQPSLPTKVFGNNKSNLSKQYPLRILLAEDNLLNYKVCLKHLDKLGYKADHAKDGVVVLDKCKELLEKDEKYDVILMDIQMPRKDGITATRDLKTLFHTQKKESRLPVIVALTANVGGEHPQKCLQKGMFEFITKTHFYPDELRRXLTKVRETVNMLNVYXIXRIYPYI

SEQ ID NO: 20909 - protein, 1002 aa, Candida albicans
DGVSKSPMKLLEILTVIMRVVETISVIHELRFVHNGLTSSNLLKSEKNVRDIKITGWGFAFSFTENCSQGYRNKHLAQVQDLIPYMAPEVLAITNSVVDYRSDFYSLGVIMYELVLGILPFKNSNPQKLIRMHTFENPIAPSALAPGWISEKLSGVIMKLLEKHPHNRYTDCHSLLHDLIEVKNMYISKLLDSGETIPNSNLNLSDRQYYLTKENLLHPEKMGITPVLGLKESVIGRREFLQNVTEVYNNSKNGIDLLFISGESGRGKTIILQDLRAAAVLKQDFYYSWKFSFFGADTHVYRFLVEGVQKIITQILNSSEEIQNTWRDVILTHIPIDLSILFYLIPELKVLLGKKYTSIYKHKIGMGMLKRSFKEDQTLRLEIKLRQILKEFFKLVAKQGLSIFLDDVQWCSEESWRLLCDVLDFDSSGEVRESYNIKIVVCYALNADHLENVNIEHKKISFCRYAKQSHLNLREFSIPHIPLEDAIEFLCEPYTRLHDHECNSKKSDVIANLNCTNEYPQNTCKVIPSIIQELYQSSEGNVLLLIFLTRMTKLSGKVPFQRFSVKNSYLYDHLLNSNYGTTRKEILTNYLNMGTNSDTRALLKVAALISNGSGFFFSDLIVATDLPMAEAFQLLQICIHSRIIVPTSTYYKIPMDLIASDQTPFDLTDDNIWKLATLCSYKFYHDSICTHIIKELNASGEFKELSRLCGLRFYNTITKERLLNIGGYLQMATHFRNSYEVAGPEENEKYVEVLVQAGRYAISTYNMKLSQWFFNVVGELVYNLDSKTQLKSVLTIAENHFNSREFEQCLSVVENAQRKFGFDRLIFSIQIVRCKIELGDYDEAHRIAIECLKELGVPLDDDDEYTSENLLETCLGKIPLSVADIRGILKIKRCKNSRTLLMYQLISELIVLFKLQGKDKVRRFLTAYAMSQIHTQGSSPYCAVILIDFAQSFVNETTTSGMLKAKELSIVMLSLINRAPEISLSYVQSIYEYYFSCHAVFY

SEQ ID NO: 20910 - protein, 223 aa, Candida albicans
CVENYSWNQMMEQAKLYADMFGFHKYWSVDEDDISTGFTALRSIVMSSSNGQIKMPINEPVKSIMKGQIEEFNDFNGGPGIQHIAFRTNNIIETVMALMQRGVEFNHTSENYYNNLKQRLNNDGIKLYEDFDTLRSLNILIDYDPSTKPKPKPKPKSKRKRNNKCNYLLQIFSKPLHDRPTLFIEIIQRHHHNGFGKGTFKGLFESIEEQQKLRGTFVKSQNN

SEQ ID NO: 20911 - protein, 277 aa, Candida albicans
IPVLLIKKRTKIIMPASREDSVYLAKLAEQAERYEEMVENMKAVASSGQELSVEERNLLSVAYKNVIGARRASWRIVSSIEQKEEAKGNESQVALIRDYRAKIEAELSKICEDILSVLSDHLITSAQTGESKVFYYKMKGDYHRYLAEFAIAEKRKEAADLSLEAYKAASDVAVTELPPTHPIRLGLALNFSVFYYEILNSPDRACHLAKQAFDDAVADLETLSEDSYKDSTLIMQLLRDNLTLWTDLSEAPAATEEQQQSSQAPAAQPTEGKADQE

SEQ ID NO: 20912 - protein, 156 aa, Candida albicans
LTQSNYNLFALIITKQIKSNQHKQTVNQIMTCLDELAHSLESKSGTTNSKTRNSKIKTIDLYQQNELLGQHSQDQDKFYRLPAMDPIARDKKPWKQDVNYFNKCYISSLALMKMCTHAQTGGSIEIMGMLVGKIPGPFHYCYGYISITCRKYQKLE

SEQ ID NO: 20913 - protein, 305 aa, Candida albicans
KVPETRVNAQNEAYTYMVEYLTERQQLLNGKNEENIVGWYHSHPGYGCWLSGIDVSTQSLNQGFQDPYLAIVVDPVKTLKQGKVEIGAFRTYPEGSQQQPSMTNKTRKDQNKPHNSGANANRKILPKSKQKDFGSHADKYYSLDIEIFTSSWDDKVIEMLKDEDSLTWMKNLLVDSNNNDKILGIRKDEIRSIELIKNYELILQGNHNADEGETIFDLIEQLKIQANTPKFMLDKLTTMKFDSNFESVLYKRLLKKTQKSTTTKKNRKELSTDIDDETMLDESDLEKNVGTGGIETSISSDDDDE

SEQ ID NO: 20914 - protein, 173 aa, Candida albicans
QHLDGSDGSLVIGGYDAAKVNGEINWTSIKNSNIHALLSEVKINGQTIPVNKQYTLDTGGGTGFLPEAAYNQVIGNLPEDPKFGTDRSQITCSLLEGKTFTYNLNGVEYEIPLRDFYTPKETNGVCKLGLQKGNAAQLGAWIFRNLLLAVDLEGDLFGLASLKNTTETNIKLF

SEQ ID NO: 20915 - protein, 222 aa, Candida albicans
PNTMVSIITFTKNVLVTLAFALLAQGLAIPEDIDKRAEKVVSLDFTVTRKPFNATAHGQHHQSQQQQQQQQPAQKRGTVQTSLINEGPSYAATITVGSNKQQQTVIVDTGSSDLWVVDSAAVCQVTYPGQSPTFCKQDGTYKPSSSTTSQNLGKAFSIRYEDGSSSQGTVYKDTVGLGGASITNLQFADVTTTSVDQGILRIGFTGDESSPTYDNVPVTLKK

SEQ ID NO: 20916 - protein, 570 aa, Candida albicans
FFSSQTIAIDIFFPSDFFSFFFFSTYMRLNSVALLSLVATALAAKAPFKIDFEVRRGESKDDLSPEDDSNPRFVKRDGSLDMTLTNKQTFYMATLKIGSNEDENRVLVDTGSSDLWVMSHDLKCVSAPNSKRNERSFGHGTGVKLNERELMQKRKNLYQPSRTIETDEEKEALEKIHNKLFGFGSIYSTVYITEGPGAYSTFSPFVGTEGGSGGSGGSNTCTSYGSFNTENSDTFKKNNTNDFEIQYADDTSAIGIWGYDDVTISNVTVKDLSFAIANETSSDVGVLGIGLPGLEVTTQYGYTYQNLPLKLKADGIIAKSLYSLYLNTADAKAGSILFGAIDHAKYQGDLVTVKMMRTYSQISYPVRIQVPVSKIDVESSSGSTTNILSSTTGVVLDTGSTLSYVFSDTLQLLGKALNGQYSNSVGAYVVNCNLADSSRTVDIEFGGNKTIKVPISDLVLQASKSTCILGVMQQSSNSSYMLFGDNILRSAYIVYDLDDYEVSLAQVSYTNKESIEVIGASGITNSSGSGTTSSSGTSTSTSTRHSAGSIISKPVYGLLLSLLISCYVLV

SEQ ID NO: 20917 - protein, 121 aa, Candida albicans
YIRGSALCERRLGDAHFSVPIQDLKTEKDGQCYLAIMSNSVIGGGGILFGDDILRQIYLVYDLQDMTISVAPVVYTEDEDIEEILNPNEDQNEVPTSTSFTQSASSSGSQPSSTISGENMD

SEQ ID NO: 20918 - protein, 313 aa, Candida albicans
RQDMSTTTLKRTINMTPFKYKLPDLISDLSKAKKIMVVTGAGISTSLGIPDFRSFKGLYNQLSKLNLSDPQKVFDLQTFMREPGLFYTIAHLVLPPDGKFSLLHAFLKLLQDKHKLLRNYTQNIDNLEQRAGLKLEKLVQCHGSFAKAKCVSCQGIFAGEKIYNHIRRKQVPRCAICWKNTKQAPIHFGAIKPTITFFGEDLPERFHTLMDKDLQQIDLFLVIGTSLKVEPVASIIERVPYKVPKILINKDPIPNRGFNLQLLGLCDDVVSYLCKCLKWDIPHADFNNNDEFKLSKLKNGDWEIVKKSTSTKK

SEQ ID NO: 20919 - protein, 168 aa, Candida albicans
ALVLPAGRGEDAGTTTSTKGMITPTPFNIDINNDLNDFDGKFIETFKPDLELQKKYRLFIQREGALSFLRTEITQSMSKRDICVLILNLGYPKKAVEDYPILTLKELAYILLKLMLTDSAQLEPKVEIDENDNKNDGTNNSDIDSNSDMDLQLELGELDDAMDVDDSL

SEQ ID NO: 20920 - protein, 194 aa, Candida albicans
KKLSQIDHALQTAEAIRRDGKPRWFQLVGLIHDLGKLLYFFDSRGQWDVLGDTFPVGCKFLKRIIFPDSFKNNPDFLNPLYNTKYGIYSKHCGLDKVMLSWGHDEYMYHVAKKNSTLPPEALAMIRYHSFYPWHQELAYSYLMDEHDKEMLKAVKAFNSYDLYSKIDQQYDVEELKPYYLELIDEFFPNKVIDF

SEQ ID NO: 20921 - protein, 498 aa, Candida albicans
FNYRCNRCRSKKTKCDGGFPCLKCVKSNQECNISAPERPSNPTDFKEKYAQNRAYTCKLERIIQYLFPDIDLKYLRENTDTFEREVCINKLKLPRVGVPITSTKPPESEDNESKLNSLKNFNHTYVSPTDQSFIRFIDNSKNQRFMERNTLAASVFANSNIYAKHNLQVLVQNALEVFSDDNKIRKLVGIFLNICETNYFYVHHGRFYKQVDQLLLKRQENDIEYLVNNWTTVSIVLVMLALASGFEFIADNSPMPKVTPDTTPGLMCYYAALPFAGFLIDLKSVESIQCLLIFGVFMTTNKLENFQSIDGGYTFMNLALEIAIANKLHLKEPFENYPEEDREVFKRLWWTCYTMERRHGVNIGRVETIAPEDITVELPVDMRGLYSNLGLSNHLSQISIIQMNYIFRDIMDLFCSKSKSHKDQSISIDPKIIRKFVEDLEVCKLNFPNYTKIDNLDPSSTRYRACIHLNLTYYLAKIYIGKPFPLYKVENHQTITRE

SEQ ID NO: 20922 - protein, 257 aa, Candida albicans
CPHFHYLVLDVTSSQQGEIYSESVSIASIVGSEDGIFNKFPGSVRIQTGGQEVIADVKSMVLERLENFHKKIGKLPSKVLFYRDGVSEGQYTTILKEELTKIKAAFNEYGKLKNIPKYSPTITFMIVVKRHHTRFIPIHDNADDPKTKKQIAVTSNENVIAGTTVDREITSPAYFDFYVQSQQSLQGTGIPAHYYVLHDENNYTSDTIQKITYDLCHTFSRATKSVKVVPAAYYADLLCTRGRDYIYGFAKDPNLKG

SEQ ID NO: 20923 - protein, 285 aa, Candida albicans
LARDPSQPVWCKNSYLIDDKQTHIKHTPYNITKYSDKSHDVTTLQKYFTTNKLTPIPSTTQIIAILKSPFTQGDLNKSYYLIRMFQLSSQGLFLTNSPMDKLNHPIQFLGAENWDNVMCYLDALLFAMFANLESFEPILFIPNHSEYLLNQLSALLRVYVNLLRSGNLITTDLTAKICEALMKLGFTEALSHKQQDSATLFEFLTQTLNMPLLTFKIDIKHGGKFSKHDDEKISKERILFVSIPNEEIEDELLPVEKSSISHTEKVDKKFNTHTTTNTIHTATII

SEQ ID NO: 20924 - protein, 282 aa, Candida albicans
FLFANFTFVARNPLTHKSFAINRLLPVNENDWIDYRRAESHNAKKKLMAKNLSLIEPTPEESKLIYDMWKSSKSLQNDVEKKLNDGIAFMKDTVMKSTLFMQPQYRNRHSYMIFGGYLLRQTFELAYCTAATFSLAGPRFVSLDSTTFKNPVPVGSVLTMNSSISYTEHLHDLDQIKEEIDNDSPFNFSLPPTNKISKSPNAFLSEPGTLIQVKVDTYIQQLEQNDKKPAGTFIYSFFVPKEGNSSFCSVIPQTYSEMMTYIGGRRRAQDTAQYVETLPTSK

SEQ ID NO: 20925 - protein, 333 aa, Candida albicans
FQQGNNLLKKRIEGDTISPLNKIVIASHYNSTFETVSNLSKLSNKSKLKDIFHALTNATEFSDLPVREGEDALLIKLQTKLPIKYSQDDYESPFFKAFILLQAHISRISIPFDLRQDQKSVLTRVLQILNAAIDILSSDGSLNVLLAMDLSQMIVQAVWSSDNPLRQVPRFTNEILGRCTQHNVETVYDIMSLEDEERNEILQLPDQELNEVASFVNLYPNIELLYEMKGGVTSNESKFVTVTIDRDEEIESLEVVKNENFPVTKQENWWIVVGDSKTRHLYGIKKVNIQKISQSFEIEFTIPNKGKHELTIYLICDSYLDADKKMEFVIDVV

SEQ ID NO: 20926 - protein, 338 aa, Candida albicans
SSVHFISEEMVNLEYLTIQLPNIRTFNETGIIAPNLKELNVRCDQLSNLEELRQFQHLKELEFGFCNYPFGLFDEDSFPELESFMCWGCHILDSEDCHNSSLIFPRNLKQLAIECPGFENVDFTTAMLPLTLTILHVSGLSFNDGYLGENLRYVNVQGSSLVFKKRFIIFPMVEKFILKADHLTFESLDFMYHLPASLMHLNLFACEQGKMNPLAQKVKWPSMLSGFVFQNFKINYETLKLLNMKESRIEEIDICGGDIKTLDADLFPVSVKDLSLVQMGIEEVLGSFEDLENLQKLSLQGNQLKKISPVRMPVSSLSFLDLKQCTFSFDITIRGFNV

SEQ ID NO: 20927 - protein, 290 aa, Candida albicans
LLILMNSLYQMTWKPQMLHRNNQGGASPFSPFNFLPKVDLSSTFGNSSGQLPVNVKIKERQYSGGDTLDEPVWVTLKRDLLQIGKRLAIVIWPMQLAQLAKKQQSRFVSFANSNGIHIPERLGNILPGGGVDDNTEQTTGISSNDLISQDNLDWDLWGPLIFSLVFAIVLAFTNESQSTEVFSGSFAFIWIFYFVIGLNVQLLGGTISFLSAISAIGYSMFPIVIGEVICTLLIHWRWIRLLIMLVLNAWSIYAGVMSVKCSGVFPGRVALAMYPVGLFYSVLSWLVIIT

SEQ ID NO: 20928 - protein, 543 aa, Candida albicans
  UNSURE (436): Identity of amino acid sequences at the above locations are unknown.
VAAFFVFGPVVKTTALDSYTIYGMKKLDIKIIPDDDDDDEGTQIFTFPASLEDLQIKTRLLTGVILPPTLRRLCLVTHLKQIEISSEGMPILEYLLLELPCIDVLNNNQIIAPNLKTLHLKKCLSMRGYNGLKKFQHLKHLTIDSSVYPFYLFDQNSLLELESFEYIGNDLQNSQYFLKSLLIFPPNLKHLSIKSAGLGDLDSSTLVLTRPLTPVVLLNVSFKTGYCHLDENLEYIDIITSDLTFHSSFRIPPRAEVLDLAAKNIVFTSLDFMYRLPNSLTRLQLLARSQGEMSPLTQKIKWPLVLGTFSLKGFSIDSSTLELLNLKESRLRKIEICKGNIQKLDNDLFPISVEELILNKMGIKELPESFENLENLRRLLLNRNQLKKVNRVKLPVSSLEHLELCLCNLRLVSPFLVSMYEEENKDAKLKIHAPGXWNMSVIDVRRTLKAIKGLSLLLSRYDETLEEISRRYYSLFDAFLTPDPYAPAYEYSGPEEVISEYDSDDLYNGSLDNEYSDEDDEFYYGSSMEEDSSIVTSDNDKDS

SEQ ID NO: 20929 - protein, 323 aa, Candida albicans
SHFLLDLFMDAILANLPPITKGWCIAILSTATLLSANRLKLVNLLFVPDKALTTEPWRLITSFCTFRSLSIELFLEVFYVASSCGQLESRFTTELSLFPTRIIDQFNQQDRNAQNQHQEQGDNQRQGQRQGQGQILQLELLRSFIDRNKSIDFLYYVGQICLSIIFVASLIHYKLQFVILNLGQILSHLIIYIDTQKTPNELINVMGLFTMKKSYYPWLVAIVTIILNHSGGGGLLDANNIFNSPLVWTYIVATGLGHFWWMVRDVLLSSIHYDSNDRRRLLKQKLLNRHGIIKFDIIRERLIWLLLPPWYWVILSKIKQRRA

SEQ ID NO: 20930 - protein, 74 aa, Candida albicans
  UNSURE (14): Identity of amino acid sequences at the above locations are unknown.
GVLENWNRKRGPGXRPGLELQNPQGRQQQEQQQQQQHQMSGYKVSPISNIESPIANGGLTNPNVQFGNGARSFD

SEQ ID NO: 20931 - protein, 659 aa, Candida albicans
QIMGYNIKQKIGICLKAEANPEMTQSDLALWAMKEYNSERPPSQTTISRILNSKNDIISRKESEFELIRRRKRANPLLRRILTEWITQANWEGIPITTPIIQLTANAIWTRLPKEGQEGNGIFNQKWCSHFVKKLNINITGSPRDVLDNRGYNLNKVWKLDEILELKRYLRDIIDQEDYAPQDVFVIDDFQLFYSLPLDQIFDVSSIDKGIKQSNSYAEHSLTIMLGCNIDGSEKLTPIIVGKYDKFDVSKSTHVSLNSMQFDSVSYQTLMNKLTEVYNIFYKSNTNKWITSSMFQNYLTRLDHKLSNSRPNGRKILIILDDCSSHRIINLKFNNIRLCYLKNEANHKNPYNTTYSGIKFDYLPMNFGIVEEFKILYRLQQYLEMINLQRSKSQIDSDPMIEENLTSTSVATTATALEVLSESDYHISLIRAIEWITRSWHSVSSERIFSSWKKTHLFNLLDWPSGNSGQLVYLNQKLNTFDENKSLKKLKEVMSYLNVVIPWEIDELVGLVNERGKVTLSYASIEEIIDSCLLEPVDDYDEMGDDDGRFDNRKNELGDVSSVPVDNSNDPWFTVSEINEFHNDPFYNNDKSIDAAAEPLELISPDNDSSAIPGLETKALSAISGLGTTSTSVVSDSPLGTTQKYNNISIYPNGSLKHK

SEQ ID NO: 20932 - protein, 159 aa, Candida albicans
ETMVLADLGSRLRGALSSVESGSDDEIQQMIKDICSALLESDVNVKLVAKLRGNIKNKIDESNVSKETSAMNKRKKLQKIIFDELCALVDSNVEPPKPKKLSTSTKTINGKKVRLSKESSHVIMFVGLQGAGKTTSCTKLAVYYQKRGSSTDDCRTSPP

SEQ ID NO: 20933 - protein, 311 aa, Candida albicans
EEVDYLLDIKNYLLKLSNIIKITPMSFRNINTELFYEVARLPLGIIGIIVDYLSKCMLPELLYFLPIRRVVASAILSDVNITEAQQRHKKDIARGLGYSRCKCTSISIKPKSLKRGSKRWNILPEVIHLGDIFAFELTYKTFPEVLYMVPKIDAYFYGYDTFDPKIDANYLKNSGVNFDSLFLYEFMHVKELPTVITSLKLIGTTLDSYVIDGLKKLSLELSGDENTTKEYSFPSSLEDLTIKGYKLTRITLPPNLRRLYISTFLKSVDFVSEEMPHLEYLLLSLPDVKNLEDTGICAPNLKTQEIHNRSR

SEQ ID NO: 20934 - protein, 278 aa, Candida albicans
QKFINILSPRIILFSLTPITPRALNQSTDAWLLINSMTTATIKIDTALFIRLAKLPSEIVAYIIGFLPKCMLPELLYFPPIKEIVVSTIFSDVNIAEEYLRDKASDVPGVGYGICYCDYFKVTLDDLKRGIDQWSIYPRCIYIDNVEDFQNVCDDFPELLFKAQSINGSFAGDEGPNPEPFFKFFLDLNIKFDSLSLSNFSDPLTVPPIATSIELLNASLTNYVIPGVKKLDVDAGSDEMETQTYAFSSDLENLLLYTKRSIEVTLPQTLRKLEVYAF

SEQ ID NO: 20935 - protein, 395 aa, Candida albicans
PFHKLSIYIFWVTSMTIINIDPDFFYEIAKLPSEVIALILGLLPKCMLPKLLYFPPIKEIVVSTIFTDVNIIEETKRHKGSDGPEAGYSECHCDRFDIRLDNLIKGVNKCNIYPRSIHIHQIGGFQNEPDTFLELLKNALCIEGKFSQTWGLDPEILLDLFVNSNVKFDHLELFDFPNPVTLPHIAASITLYNTELNNYAIPGIKKLIFDVESDDDRNQTYTFSSDLEELYVTTDNSIEVTLPPNLRKLRLYKTRGPVDLVSEELVNLEYLLLMLPNIQSFSETGINAPNLKKLILECGNLSNFDGLKQFQHLKDLEFRHLRFPITLFDDGSLPELESFACWGCSIYNTGDVNNSLSIFPPNLMVLQLEICSFENTEFSNWYFLFHHAAGRTRAC

SEQ ID NO: 20936 - protein, 578 aa, Candida albicans
LRVSKTSFRTMSSTDIGATLFARLVDNQSDTIPIILNYLPKCMLPELLDISSVRNAAASTILSNVNITDSVSRHENIYGDDNSYSKCKCVQFDIEPASLKRGVDQWGIYPTKIHFDGMEQFQSIFENFPEVLQNARSINGSFYCLEGENSKRILREVVSSNVKFEVLKLFEFGDMGSVPLFVKDLDLVNTKLDTTCISGLQRFYSNTKKINTPLLNYSFISRLEQLSITTNTPTEVSLPQSLRKLTVDSCNGTISLSCEESNNLKELLFRSMNTKSFVETGIMAPNLKVLRLANCYDLTDFDSLKGFTQLEKLSIKDTIYPIGLFDAISFPKLKSFTYGGVEDLFESSHVWLSSENLPEEFNNPILKFPPNLTLLHIEDTDYFKINLDTLVFPVSLTDLRLSQVLLSEGEIPLNENLESIFIDTPKLTFSGEFTLPKLAKKFTINADHLTFQGSRFLKELPTNLLSLSLKAYESGEMKTPVGKIKWPSSLKSLALKRFDLNHKTFKMLNLRDSKLEDIDIYKCKLEKLDVHALPTSVVDLKLVNVGIENLPPSLERLEKLKHLTLRNFHHAAGRTTLE

SEQ ID NO: 20937 - protein, 194 aa, Candida albicans
TTMLKPNVAIIVAALKPALGIGYKGKMPWRLRKEIRYFKDVTTRTTKPNTRNAVIMGRKTWESIPQKFRPLPDRLNIILSRSYENEIIDDNIIHASSIESSLNLVSDVERVFIIGGAEIYNELINNSLVSHLLITEIEHPSPESIEMDTFLKFPLESWTKQPKSELQKFVGDTVLEDDIKEGDFTYNYTLWTRK

SEQ ID NO: 20938 - protein, 355 aa, Candida albicans
VPSATFKKGNNINGISLMNKTKKDVSSINGSSTSFSSSSASSSIFSSVAPSTSSSSSSSNGTTINNPAPKLPTLGSKISSPSSQPFTRSTTPLQTLPPLHKIASHESSLPPLHNISTYNNNNSGGGADGGQQSMANYSQTNRSPINGNQDNNNNNNNNNNGNNNGNNNSNNNGNNFTASAHEVTLLKTRISELELVNDLYRTRIMELEAMEQAARLRENSMKKRLDEVMNLQINYQNLLNNNGGMPSQTQPQPSQQPQQAGQYYSNNNNNNNNDQGSQSISPNVSITGSTTITSPNSRSKIISETTPTHHQQQQGGVGAGDNESIILPPLKRNRTDELTDANGNGNGNDNKKVKI

SEQ ID NO: 20939 - protein, 816 aa, Candida albicans
YWKAYDHDMVATDIDISTDGSVVLCTRSGTVFIKSTLSSNQRKNSMSGATLPIPLTENKFKKIENVNNVVRVTCDPKFLSFGFMRDDIDLLPLELPQNDFFTDIETLSPAVAYNFNRKQNKLFDTQDHLYIANFFTASRNNTHEDDADDAEYDKLYSNQDALVINKIEEIYNSKFDPRASKRVKALSTYENIVSEEVYSTIKRCSGYGEDYVDGLKDILSNNENLFDANFEFAFAQDAKFGFHSRVLEFRSSVFQKLLQLNDKNETLIGDNIKIVWIPEQSTLRVLTTISPVAALMFMHSVYSGRKMDNLEQNVFSYSSPELVRLRINQYQSLCSLFGIGCDRLSVTDAFQDLLNSNTGDVVIKASDGDVFAHAFVLKARSAFFETLLSERWDTEEKGNVQYVDFTGLTKFQVTLILRHLYGVSNESLLDCFQYDFGEKDYFINDLLELIEVADELLLFQLKSVLQLAICDMISLDNVLVLLVHGFTLNARQLFLNCCWYIFNNLEVLMFAPGFKEIPNETMQLLEVFIDKLCNVQNGTKNWIDQNPNILLEHIENIEEFNEYFMSDRKGFSSFKPLIDNGYIDAIKTKETVKKRKSRKSSTSAFNKDISDFRQGLRRENNGESFPPTIIDENDGFILVENKTKQRNASSSSPNILNMNGIVEPTNKIGNLSVIGKLTSIHPNPESFVQSSGLPSTSNWATKPQSSLIESNTLLPAAISTTLTTAKSKPTKVKIGPVTKLSQKQRKRLAAAAANDANLEQIDQKTTKESSTIAPWSTCVADTPISNLQNINNLPALGSSKPKKKFTSISRFSPTGR

SEQ ID NO: 20940 - protein, 117 aa, Candida albicans
RLSMSRRVLPALHEIAIRQGLENINQLGYPHWSFVKLDEPPAHVLTVHYQLKNFKTTWEFLNSVAELAASKRHHPTIITTYNKVDIQLTTHDSDNSVTQDDLDMAEAIQKQYHELTK

SEQ ID NO: 20941 - protein, 290 aa, Candida albicans
EDNNNRNQINSCRQLLNERSQEIYKQLCTLPYLQPTNWIKLNIRHNLLIKLGIPINLDELNDTNTISANPNNKNIVTSETQNDLKIPGYNFGSGGGGGSGGGFVSVSGRQRKSSISINDINWNELNLISEIPKFESLNIDDNLKNSLINSTLDKLNQFELDNLYHNLTTTTTTTISVTTAAEGDGSSNNNNNNNKSNSSSNDSGSTIGGGHANSQWIDEKLNKLTSNYNELLTLSSIWINQIDQLHEEFEIYENVIQSFIGYNQKLRREEIFENLKKLKKKKKKGKATKK

SEQ ID NO: 20942 - protein, 244 aa, Candida albicans
HNFYNYITTFPETTFSQVRGKPHEVLKLIDEYPQNFMNIGPHKGTQIVTRIKEKAPKTMIELGGYLGYSAVLFANEIADDPDAKYYSFELNPEFAKIATYVIDLAGLLDKVEIIVGRASYTLPAFRQRLFSENKHYTGLDFIFIDHWKDLYVPDLRVLESLNLIAPGTLIVADNIITPGAPEYVVYVNFSPDEKKLYNETTKNPEGKEFIGRWNILYDTKTIEVATANHKDAIEVTKCVDYFSG

SEQ ID NO: 20943 - protein, 242 aa, Candida albicans
TFEEPLKLTITTIDWHPNGVLLACGSTDGHVRVFSGYIKGIDAKPDPSVWGTKLPFQTLCGDYTNETNAWIHGVKFSPDGNALAYVSHDSSVGFVYPQGEGLPPRAIFNVKTDNLPFKSVVWLNDQQVCAGGFTCNLVVFQGDENGWQQAYQVEEQKDLTKEVPHSKLGEGDDDDEEISSHQALNMFKQMDLKGRVSKPSAGGKPAKALNTIHQNTINSIRNFDQGRVSTSGIDGKVVIFNV

SEQ ID NO: 20944 - protein, 396 aa, Candida albicans
RKHTRKLTLIDHMAVLRDHYFKLGSELPKERLNAATLLISELVAADNEEEWSYALNRLLKGILTTRQSAKFGFSMALTEVVNELNNRGTLTVGKYLDLLVETTKLTSSMKGKEQRAVLFGRLFGLQVLINSQIIILKSEPEDMLQFVEILMELSNFKNWIRETGIFTLIQFIKLLDNSNVEYSKKIYIKILNMVNNLGLNLSTEGLAIYLSVPQSAQLSQNVTNMKANWKNGDPFYKGNLPVLAKVLKDVEVISDEETGDDQKKKNQQKSSWNSRLPFVWDLIVAKFNQVADDSNVEDEMQDQLVTSKKRKKTTSPKHNNKRAKIEPEYISLKEFWKVVVDETLFSEKSSNERKYWGFEISTKFVTSLETTSLVQYLFTPNFMRCVINQHASSTRM

SEQ ID NO: 20945 - protein, 220 aa, Candida albicans
ARDFPAPWVKNWSSTKETVKSGKKNFGELGVVRTKPGRSDSLISYSKSCSDKLCLKQLVGICNATTSTLFKDSIFLDYLVTKNLPAKDFHRCFRTRFDLPSVVHPLQLLTYDCDGYEFVKSEEKLPSQLSLLHIVPLNVTQVLNNGVKNGSFIKNKPPKKGGESIICNQNFINRLKQIREVDYPDYVSFKHSNTARQALKMAGRKKLKDWVSSTADNFVL

SEQ ID NO: 20946 - protein, 252 aa, Candida albicans
IINKVNVPPHINSISFIRENFSDASIKEKLGGELGLKVYNIVRGINAIELQSTIEVKSMTSTKNFTSFVISNLFDAYDWLKVFAGDLHNRLIDLDSENMELSSTELSNKSKGIMKRPKTLTLGVLSKNGTRQTRQMQIPIHKDLDKMKDIFFENGCVLLREFLEFNTHISLLNNRTPAKDIFIWDPKKVKIMELINMSLTISKCVLVEDRSTLLKTTDTSFNKEEHIAKLFRDYNQAPGNNHILISSTTTNN

SEQ ID NO: 20947 - protein, 408 aa, Candida albicans
IRIKYDLKMFYCGLIFGFFSCARHQTYPIYYLHLDRLTFPNEKKKNNQRNYKNSNNDDNTTTKIINVRKYLKDELRSTIILIKQQTFTKPKHYPGTMLQSINGLRILTLSDIQGNFDIFTKLYNQHQPIDLIIHTGNFGFWDINTIQEYNELNYLKQIVAFLEVLKPDLVEELNNSSKILSTNGSGSGSGNGGNGNSTNPDELALFKSELLSSKESISQFQQYVDGEKVLPCPVYTIFGPLDDPKIIDKIQTKQVTIPNLFLLDHKNNYEIKTANGTPNIKLYGLGGTLKIHSLFDNGNLNYLGVCGKIGELWISLLQIAELYINVTNSKALTTSTTKNATINIFISHVPVVKAPLLEHLAIITHADFTISQGLHFRYPVMGNGMSFVDSLGGSSGFSPAAGISLSGW

SEQ ID NO: 20948 - protein, 153 aa, Candida albicans
TLESTLINKIETTTGYNMNSSRLANNSHSVSKSSSSNSVYISGTTLAALQPAKSFNYHQGASITSLDFDDAGQFLVSSGIDKSIQLYDCHKGTHSKDIQSQKYGAHSARFTHEELNCLYASTPEPSDNNENAIRYLSLSNNRYLRYLKGPKAQ

SEQ ID NO: 20949 - protein, 266 aa, Candida albicans
NHRIKEEERPMEDDLERMQDDKIDYLKDQMIKAANSDVEKNSQGQIATEKLKLLKEVSDILARADLAIPILDNNLLEAVRLWLEPLPDASMPAYQIQKELIHALETLPIKTDHLVASGIGKVLVFYQRSKRTEPLLKKIVDRLIGDWTRPILNKSDSYKDRTVQFHEYNRNKFTNKLSRGVKKREAKTLYEENAERRKRAAIPSTRTTAYKIAPQVDKSLLMRQQSRHASNDERFKRINLKLTSMSVKRKAAKKGGPSIEGRDLAM

SEQ ID NO: 20950 - protein, 447 aa, Candida albicans
PTNQLSSIQQKMNTSGYWDQSSNNNTSFSQHEVRSQRELSQEEIRESLLLSSSITDLSFHHHHHHNHPHNHNHLIHAIDEESSNYSGSQNHVGNNLFGVGDDEQDEEEDDDDAYIEGDVRMRHSGISLDEVVYEENENDADNIIEDQSNPSANPSYNSNNNHYNIAEQTPPSLEQIQRVYYSKGLQELEELQLFDLSPLATWKLSSWKQRFGLKQLRDDSPDSYWQSDGSNTGNSGNDDNNSNQLQNPNNSMLLNQLSNPHSITIQFSKKVALERISIFTNYSLDESYTPSRIKIMAGSSEGWDLIEVCTVNFDQPVGWSHIIFNGIRADGVLKCFLIKIIILANHQEGKDSHIRAIRCFGKKSSTSNQIRYANVANDNDYNIHDSNDSLHHSEMLRDLSLATTGTSAAGMSNLSGFLLNNRIILGLSNKEEEELQHEDQGLIDRNL

SEQ ID NO: 20951 - protein, 237 aa, Candida albicans
IKSKQQLFLHQTVSTQPYLSLPPLIMPSSLEPSSKLALKGSLKIVCDYFEFALNSILYQRGIYPQEDFVTVKKYDLPMVINDDYDVQKYINNIMKQIKKWIYGSLMSKFIIVIVSKTNLENIERWEFNIETKDQEETTENGDGDGVGKSRQEIQKEIRAIIRQITSLVSYLPVLKDDDEYTFNVLVYTDPNTSIPIEWCDTQGDGKVLDGDNVDNVKFTSFSSSSPRGWPDPRLIIG

SEQ ID NO: 20952 - protein, 474 aa, Candida albicans
IRFSFLFLSIHLGNNITKYSVSSIMITTTTTTATSQIGDLNEIPNLKPPRETFVDQPKSPEDVNLEELIYDLQNGTKNVNNLHLYHSIFILSKTLQFIVKLQEHPDLYNEFRWQQLNRLGINEDDLIDKDTGNINENNERNANASSTLFQPQPLHMTKDTDFANEMSNIRSNTPSLSPPPLKMAKFHKNSIINDNKYYDELETSIEARIVDDVEVDRDSSIRSPDDISTLNIPSPTKEFESIIDENIDDIKYFSDNNNNENNNNNNNDEPPPYIPIEQLIQSTTITNQTYNDEQINEIYINKLKLEITNQHKNSQKKLESQLESLKIFNLLKTPNISIDQFLNRIKTYSSNISIISYLNTTFLLFKLSIYLNKITLNLNNSFRFLIGSLRCSIKIFEDIYQHQSKFNNVVGINNLPDLLKIELKFVYLINFNFNSNFNCFIIDQFLKLEFIQLCLFMKSNLPDDYNKIVNNIKS

SEQ ID NO: 20953 - protein, 142 aa, Candida albicans
SGLVPSYINTQMTTQKQHQQQHHLQLGQEKNKALTLIICVCGLYGTFLTWSILQERINTKPYGDNNEYFKAPIIINLIQALFASIIGFIYNYVTTTTTSTKTTTKTKTKTNSNPFSIFFTNGKQNCNVLQFVFTTRRLAGPR

SEQ ID NO: 20954 - protein, 247 aa, Candida albicans
RIVSTHLRILFMELVTNKNCYSWNNFYKKEQDNFNENEEDTGECWFDDSDAESKMIQFIIDKLNEEELPEEISSQSVVRFLDLGTGNGHLLFQLLEDINEEYEGDKTFEYTGIDYSPDSVKFASGVAKRKYSELKVNFEQVDLLQESCSFLQNKFDILLDKGTLHAIALNQESLADFYGKIRMDVYASQVEKMMVLRSILLITSCNFTKDDLIKIITKVFKFGKSGGRDKLIQVSQFGWVSKRSYTW

SEQ ID NO: 20955 - protein, 616 aa, Candida albicans
KVGNRVNTVRTLFYSIYKQIVNSFLFAVDIARPLQESHRTNKLKFFFFHIKKYLLHLSVLHSSAMPTNIQGEEVIIPPKDEEEILLEKLVFGDAAGFENNLKKLDNLYDYSDEEEEIDEKGLEKESDIEDLQDEDLFFIDDGNNEEHSSGDDMEIDQSEDEEEGEDQDSDNAWEDSDDEKVNISLLTSDKLKKLRKTPQDSVISGKSYIIRLRSQFEKIYPRPQWIEDIENNSDDEKDLSDEDKVDDEEGQVGSTTALLNILSSTEKFINTKQLKLIAANKISITRLKDANYKRIGKSGIQTIDFHPNYPILLTGGFDKTIRIYQIDGKSNNFITSYFLKNCPIMEASFYPQLSGDDTKTSNLIYASGRRRYMNKINLSTGEIEKISRLYGHEQTQKSFEYFKISPQGKYIGLTGNNGWCNLLNAQTGHWVHGFKIEGTIVDFAFANDESFIMIVNSAGEVWEFALEGKITSKTPNKIIRRWYDDGGVGITKLQIGGKNNRWVAIGNNNGIVNIYDRSVFAPETTHPKPIKTVENLITSISSLVFNPDGQLLCIASRAKRDALRLVHLPSGSVYSNWPTSGTPLGKVTSIAFSPNNEMLAIGNQTGKVTLWRLNHY

SEQ ID NO: 20956 - protein, 414 aa, Candida albicans
RVYNFNKNNQIISIKRIYLLLNMESLRPLTQIKKLNKKLPSLVDISLSTIKKHIHLITDIGTTPYHLLEPILQQIPAKQLNELELNCSQLLSYSDKLWMKLILKDFRDRPPPPPPCAATSPIKLNQKHGGGSGGICGLDMPYKSLYYKYCQDRDEFRKDSAKRLRHANKSLERQKSKNKIVAIDEVLRDPTIKSRRFYDLPAYTNNRKSYGMMGNKNSILQKAKRDTIVNRTLIFGGNNGSGTNRHLNRYDPFDAFKVDKKSSISSLSTGSKFIRPPKTTTTNNNNVRPGVRRTTFFNSAGSGQSTATTTKRAQPFDSNNNNEPNKVNPSIASDTKSNLNSAPDSKQNCETNNTTTTARQPSIFLQFKRKSSIMTNDLTSTKKKKAKKLNNQSELLEVNETPSKLKPLKSSIFS

SEQ ID NO: 20957 - protein, 94 aa, Candida albicans
SASSSATNQAPGGLRSAVKRKTTQEKKAQSSNATPLSTRSAGAGGSSSTMMKLFTDEAQGLRVDPLVVLFLAVGFIFSVIILHVFAKITGKFTS

SEQ ID NO: 20958 - protein, 307 aa, Candida albicans
ILFNTKLSILIADLIYNKQKKKTPTVHPITSKFPLYMNSLSIKFRNRHCNNLLIFARNKSKQNVRKYIDLVSNDTYSNKRRQSLFKSRAAFKLQEIDSKYRIFTKRTKNIVDLGFAPGAWTQFAVHRLEEQNLSHNILGIDINLATPVKGCHYMQGDIMNKSTHAKIRNFFEKQRLRETQDYQTDTSSDEEKQLDLIMSDMMVDCTGTGLADHIGNMELCTAALYLAYLELKPEKDMILKVWLGLELKLFETRMNIMFKKVIHIKPDASKDRLSELYMVGRRKVDLESKGITFNDILNATNSTEKVS

SEQ ID NO: 20959 - protein, 91 aa, Candida albicans
ALWTQYDDEFDGLMEIEEADQEDQEAGGEEEEEVIDLEGLEPARKLNKGTILAKSIEYIKFLEMKNERMKQEHDELVLKARMLGLVIDEDM

SEQ ID NO: 20960 - protein, 341 aa, Candida albicans
LLGGLSSSPLVKTSDKTCKFVTPPADSSIEVLNDFYWTDTDEPHVARRKMILQKYPEVTKLTGHEPKTKWYVMGVVLLQLGIAYYIRHTPVFSWKFLTLAYVIGATANQAIFLAIHELSHNLLFRKPLHNKLFAVFANIPIGVPYSASFQPYHQLHHKFLGDMYLDTDLPTEYEGRFLSSMPGKLFFAIFQIFFYALRPMFITQIKFTYVHLVNVVFQLIFDHVMVTCWGWKALGYFIVSTFLAGSLHPCAGHFIAEHYVLNENNVPRHQKIGGTNISKELLPAETYSYYGTLNMLTWNVGYHNEHHDFPYIAWTKLPELKRIAAEFYDPLPQVTSWVWSY

SEQ ID NO: 20961 - protein, 66 aa, Candida albicans
QTVRGLKFIMITAPNVANSETVTDELFRHLNLLYSDNVMKDPFYSLDMPIKSSLFDGRVKQLFAPL

SEQ ID NO: 20962 - protein, 179 aa, Candida albicans
QIEMEDRAIHTSPTRWLHHYSSTTDTANSGLQKVDTRWLNKTYFPKQAIQLESFEGDNLITQSKPSMFSRLLSKFRSIGKKEIVPPNYRSLSILSEKIHKNHSVSAFFPSTTSKETPYENIFSPLVDKPMDTIDTIQENNCTMAFIKHDCRTESNFFSSDFFRDSVRPVIDYDESEITD

SEQ ID NO: 20963 - protein, 291 aa, Candida albicans
RFKLTGDPAVRGEDDGLEMEIKDGFMVPINETGDSIAIEDQVHKSLYQLYKKAHPKETVLGWFGSSNQIDDITSLIHDFYSKGVDRAFPFPAIYLNVEFLNEKNQVIEPKITTYIGAAVGKPVSNTQQIGWKTTNVNNSYIFTPIPNEVINATITEKIAFKTLIDQKINQQNDNTNTNTNTNNNNNNGNNNNTDDLSYLSQQLNKATDNVGQLLSYIENNGNKDQDIDLLRLLSNQLLNKPAILTNLPELEKLFKDHNQDVIMIEYLTKAVKDQIELSARLTASAEADKAR

SEQ ID NO: 20964 - protein, 81 aa, Candida albicans
  UNSURE (12): Identity of amino acid sequences at the above locations are unknown.
LSIHLWGGGGGXTHAAHSTLYETHLTGEQRPVKNTVEPAHSSDPAVTDTTDIAFMGTLVRRRTWYCVCCCNNRSNRVWVPV

SEQ ID NO: 20965 - protein, 168 aa, Candida albicans
FEIYNLRIKMVDRLETTGPVTTTMTTTTIASPQPQPLQNSTIINASPKSDVNKIHSRTSTIDTSATSTFDNNKLLISTVLYKRSRHTRQWKKKWVVLRKCQLSYYKDSKEYKPLKVYHGEDLLSFSIIPDHTKNHFALYTSNKVLHFRAPDETTFHQWVDTLNEYFNS

SEQ ID NO: 20966 - protein, 269 aa, Candida albicans
LELVMQIAVLYLLLTSCMIHIYAITSSSTSSSTGDHIIEFDDNSIQSTLELADFSFIYFYSDVCKYCRKFDPTFENLSVLYNQPKQKDTIKKTGSNNERLYFQILKTNARQNNQLSQLFKVSQYPTLKLLNYKTKEIITYDNKNNRDLQSIINYLQQNLNIEPQFENFKSKVKYYQSPPSDSFKQDLDFFGNENELEKNDKLIFFIASYLPEWSDYQYPAHFIHQLALDYPDLTIIIVDYEKLNDYGVLSKYEINSFSQCHVFEKQWGL

SEQ ID NO: 20967 - protein, 618 aa, Candida albicans
SKECAAKNIYLYGFHDIVLDHHCFGSKKLNNLRIQLRLREEKKRKKKILHIFQLGRFIATLLADFVMTEPKRRKYNKSRRAISTNSFLVKHPLNVKPGGNSFIASTPILQKQRKDSLGDFCILPDEIIMNIISYITDIPSLLNLSHTSRILYAFLYDEEIWKRVYLQNNEHYDTKPWLGSWRSTVLNIIENKELLQLPDNLLCSDLLYRPIQCSQIDYTKLFHEIIREEEVYHRDAMLGQLDDLPRGRIQRIQESSLSLDEFNANYHSSPFILVNSDSNRWPNWNFDLLFHRFPNVKFRQEAVSWDLQKYSQYLHNNKDENPLYLFDCKSDAMKVLKQEYKVPEIFQDDLFTVFNSKQFNCRPDHAWIIMGSARSGSTFHKDPNSTSAWNAAIQGRKLWVMLPPHMTPPGVGTDEEESEVTSPVSVAEWVISGFFNDSTKIDECLIGITFPGECMYVPSGWWHTVINIDDSIAITQNFVPKSKLAEVLNFLKNKPKQISGFRLKEIKQCLDFIAKDSSDEVLTRYLEAFNLLTIDLEEDCGELQDLPDMPIFEIFKQLLNNNGKGEILNDALEKLQKIELKNYERETGKSKAWEKLTEPTNSGTATFSFNFDEESDSE

SEQ ID NO: 20968 - protein, 175 aa, Candida albicans
ITPHPYSPSIMSQLFEWAFGKKLTPQERLRKNQRALEKTQRELSREITKLQQQEKKLISDIKKSAKLGQISSAKIQAKDLIRTKSYVSKFTSMKTQLQAISLRIQSVRSNQQMAMSMRDATRVLGGMNRSMNLPQLSRIAQEFAKESDMMDQKQEFMDDAIDDSSPRAGRSAIAL

SEQ ID NO: 20969 - protein, 312 aa, Candida albicans
DNFNEKAKISSQTITFHCREMYCSARLYLFISGVWAIDVCCYQRKKSSPRDIEWILRRRFLISNNFLFIQNEWQNRKFGTRKKILRDFSHSSTSHRNISTPIYQLNLLPPTMAGLEQSLFQLKFTAKQLNRQATKASKEELQEKAKIKKALSQGNNDIAQLYAQNAIRKSNERINLLRLASRIDAVASRVQTAVTMRSVTGNMTQVIRGMDKALQTMNLERISLVMDKFETQFEDLDASTNYYETTTNNVNALTTPQDQVDELLNQVADEAGIEMKQGLNATKVEITSPVAPNSISEEKEDKLAERLRALRN

SEQ ID NO: 20970 - protein, 206 aa, Candida albicans
  UNSURE (206): Identity of amino acid sequences at the above locations are unknown.
SHYCSLHKQLYQFLQMSLTLDELTQLKKQVKERDEEIDLLNAFINKNPRLLSPCVIVHGYISIGKTFTVTKFLKALGTNFSTINCDECVSKKILLRRCFDKIRIDSGCPKGSLNTRNDLAKYGNNGDSFSTFVSALELFVEEFDYKLEHHVLLLDRFDQCFEYVNDLLAGFTRLRESSTLLQNFTVVVIISGEDPKEILTLSNPQX

SEQ ID NO: 20971 - protein, 196 aa, Candida albicans
QPTLTFWTDNYHTNMAYRLNPVDEDYVQAKVNKDKQNTTTKLLKIFNKNPTNYSNVKLEEFKPWITEEINKQLPDDDIVIDYIYELLQDYGNEPGREFPDILNLNLQLANFLGEKESKVFCKQLWSLILEASNEPDGIPAVFKEKKEKPTIVQKNEESESTQKTRTKKTNYNRSLLLCPTWIGNLEQLSTGILPRN

SEQ ID NO: 20972 - protein, 586 aa, Candida albicans
QVWLLIEIGPNIPVTNYNITNVKLWYPINQGKQLLYQFSLIINGICKTTQKVGFRKIELVQVNDKYGKSFYFKINNIPIQIWGTNWIPAHSFQSRLTKLDYQQWINLIIHGGYNLIRIWGGGQYEKDILYSLCDEAGILIWQDFMFACGIYPETIIESVTQEVEDQLIRLRQHCSIIIYAGNNEDYQIAELINLDTNNSTQFPAKNIYEYIIPDKINKLCNFTPYHYGSPYSDTSHKSSDPTIGDLHQWNVWHGTHEPYQNWPELSGRFVSEFGMLSIPSLQTLTKYINESQLSINSTLLNFHTKAAGGIENLDNYLWDNFLKPESLDISHYIYLTQLLQSEAMSLAYRYWRRNWENYKTGGIIMWQLNDCWPSISWSAIDFLKIPKLVYYGVKREIQQVGIACRRYQIKQQTYKQQNVFEVKNCLDIWGFGEFLDIGVKIEFYTEYGDLYFFKSIKNLVFLNNQVNMVAEKLCFDNINDNTIIYLKLIENDKIIARSSDWPQPLKKLPWNKLSTNLTIEYLGQGDFQISTTKPVKRLELYFDYTHNYLFDDNGIDLFPDDPQIIHINNFDELDVEKIRYRHLGSI

SEQ ID NO: 20973 - protein, 241 aa, Candida albicans
SNYTIMLVEEVPKSTNAKTSTIYFSSSINLTARLLGKSTNTGESTSNSNKGRAKVNYNLTQLMNAQTQSNEPTNTGPLKSSQQIQLERLVSKRLVELNQETSTKGFELPKNFVYTSIHSTGGGDNTTKPSHKSRLGNTPATKKILAARRNLNLYFEEERNLISVNTILGINYQFVDFTDIDNNKSATATASTKRRKLESVKPKIRLCCICGDKSNYLRCLSCGLYYCSVKCNNLHQELRCA

SEQ ID NO: 20974 - protein, 222 aa, Candida albicans
CLTHRGRGVFNSEGSPKTQPNHSVSLLNNEVRLESSTSSSSTTVTSTALPPPSAIDRSVSLVGGSPFDLSSRMNNQQLFNRTPSISTPPTQNGRLPKISSPLIPSNTESQSPTMVTGTDNDVGVTSKGSTSIISVSKKPSVFSNSLQERLRPSMFEYHPIGNNLSKDVLTIPKISTNSNSGSRTTSQSSMSSASALSSKKSSLSSISSTHGNLSIWTSTNIS

SEQ ID NO: 20975 - protein, 351 aa, Candida albicans
PFGNCCLKINNGFASKHVNEPLDHLINTPAKIGPQVFIKSNCFQYWWSPNLIHQERHLLIKMIGRIIYQLDELIRPYTSKVLTVISPFLIDEDPTVRLETREIISGLTKAAGLANIISTLRPDLDHVDEYVRNLTARIFAIVANTLGLKSFLPFLKAVIKSKKNWTARHTGIKVIQQLCIMLGRGNGTAILPYLANIVEILKPPINDESLQVRTITALTLAQLAENVSPYGIDSFEPILEPIWFGIRKHRGKGLASFLKCIGAMIPLMSYDPNYEDYTNYYTTELMHIITREFRSPDEDMRKTILRIIMGLPLSRKLIPDYEKSIIGPFVNAFLESFKLLPDSVQITKASI

SEQ ID NO: 20976 - protein, 119 aa, Candida albicans
DFLAGIVVFLEINLAKTPPMVSIPKDNGVTSNKTTSLTSPAKIPPWMAAPIATASSGLIPLDGSLPKIDLTVSTTFGILDIPPTRITSETSEVDKPASFKAFLHGSMVFLINGSTNCSN

SEQ ID NO: 20977 - protein, 320 aa, Candida albicans
SLIKVCVVLFKLYLFFFGQKYTPTHYQIVVVVVVVHSTNDSFIIFLIANNHQSSLNTIYVYTYTYYTMSYSDHPPIIFFSIGNPGPITRHSVGHFMLKRLMESSSTTSIKQLSNYSSYSLSVDSFNNIIYIKSNTYMNESSKAWNKFKLSKEYRSFIKEQDQDQDHHDQIVSVIILYDDFENNLGTIKLKQFKKKSNNNESHNGLKNLKLSMIDGNSSNATGEAIYLLGIGIGPKPNNNPSGEIMRQWILSPFNKQSEKYKLETESFKLLQLYIDTMIEQISNDNDGIIKDVNKFNAKMTKLWKRKQSEQESLESSQWLE

SEQ ID NO: 20978 - protein, 200 aa, Candida albicans
DSADDTSIDGVSTDKDSRLIDSTAGISADDGSVDEVSVSGVSVEGVSVEGVSTDEVSTDGFSTEKDSTLADSTVETSGDGDSEDGSVDGDSLDETSVDETSTDIDSAVGDSVDGDSTDMDSTGNDSTDGDSIYEARTDEDSKTEDSVDDDSTFAGSEENDSTDDISLREDSTTGGSTDCDSMIVVPSSDDSSSTDSITDD

SEQ ID NO: 20979 - protein, 119 aa, Candida albicans
LSRMDNFLKVVIFEDIKSNLETSTGTGSSTAMTDTNTFTNVPVVTKVTGWATQIDSLGTGNTQSNSLSQWTVSSDNSFDIRSSKCDDSKTSWSSCWMTSIVRTRSDSNNLSGFSSNSDE

SEQ ID NO: 20980 - protein, 883 aa, Candida albicans
HRETSMAETYQSTLYSELFNDSIDNDDDFYKSIFVTPIAKDLLTTVLNTNTEAIVLTSEVSDKNLLILSRIYFSGLKVLAQATNYHPLDVTKLSNEKVKSIVGISKQNRTVSSEKLFDDESGDITELNGNVLKNTSKQTLNEFDDGDDLTTLSGGRQGWQDLLSNNPGFPLKDENAFSNLSEKDRIDLIGNVLKIFQVWFQNLIDVDFKLEVSQRSSGIQLKLRVFEFCGENSNGSFLIELFTILKSFLATAIKEIEDTDLESKFISLSAIKESINLLKKVFTLIFLDLDMHKKGDNEFKSLVKLLLVFFEVDFADEFWKLIKLTSPDLEDNNYKPPKIVLSLETMSTFYLLMGVLANTPSSLFSEGKRNADITTFSVEMKNPYKSYFSQDFKWDVFNQQVNLKLLPLFCVEFNYCYNFRPDLVLEQIQNSSLINWISGNRLSSDIYVNCLTSQTITNLEVNKKLSVAGSKSDLYCQELNKIYNSKIQNLQAKQSNEEMNLDLSKIFPVFLHMYTFAQNSSFNSILTTQQYHFYDKIDDRTDDELNNVELFEVWVCLLSYVFEYQYRSTLMQDLTQLALSTLLTLPLNNLVDYQINEYKWKLCHQKVPFVPLDLGAKGHKPSIFYILDTVQNLLRFNLTNRLHVVNLSMGLNLMYNILDHVKADSNIELDKYSWDNLFLSLFGLIKFIKKQNLLILKYINQRDLGSLTEECFLVLNLLLDTRFSSVKQVIVQEKSSFMGLFDSDETRSINYALIYNILLNFEVIQTLINEFGLSESEHLTNLFHCMEHFDKLFYLTEDSKKERLYKKTEVLDFDFDSPVFVAAINSFTDAKNSNQTENSTEGTQSPITYQYNQTLKYSLKQKQRAVLDDQAMFSLIHRTFFSE

SEQ ID NO: 20981 - protein, 395 aa, Candida albicans
AGLLVWLFSLGKKMVLNFDEELNLQEYTISNQGSKRTRSVKPDNISNILEEAPNEIPNNQLNVDFTNSELEYLTCHSLTAHAFENSEIDVSPAISNQTHQLLRPSFSSEYDTDTTDLIGFVEQNTHHAVTTSNRYNKSSEELVFQESIDYSTFLENVLERENNNSIGNIESSREFDNAAANLFSSENCEHDLLLLQHELQETGIPIEQFQPQSYIYNEENDDFLNQSPAQVNTAATITTTTTLLVLVLLLVKSPCHVTSNYEDFVTSPIYEWPNDESGVSVDLLNTINVRVASLEPKTVSDAVRKTIREEFVIQDMFLNGQSPLPPEIPRSIRKKSDRDVEWTPLSVYKAYTNIKSPTNGKEAYNHLVPYTSCIGTLNYRPKDHAAWKRAPNRRR

SEQ ID NO: 20982 - protein, 70 aa, Candida albicans
VKVPVLSEQMSLIPPKASKESNFLTMTFFVTMTCAPTAIVIVKTRISAEGIIESATQMAYMATSLLTWNF

SEQ ID NO: 20983 - protein, 348 aa, Candida albicans
AAWFLPAAWCKTEFKCLKPKKFFFSFCSNSIHNTELPLRSFSFLTLQYMDLIQHYTSETESETETQEEGDRDFPIESDEKEGENKLESQTSIPPPLPNIEIYLQLYQQNMSKTVATTFGYLPWKPPFAAIRNIERACLRTISKIPLLSENYKFVSTHKDTSRLVKQHLTVFPGVALNTPDTHLVADKIFESVAKLEVPKSMIVTVGGGLDPLSLILNKPRKAIRFQTVNYLELARGFTNDRLFLLIYVKHTADSRKYADELTKLCRQTLEDNGYLQNPERYSPSSYHVSICTGYLKKAELLNKDIAKVNKQLRSITIPELVDLLFDVEELCCTGSSETIYSHRLLPYT

SEQ ID NO: 20984 - protein, 168 aa, Candida albicans
SDWIETPPENRISKDAQIESLDNIVISGYVTINRNVKISLDSPTPSSSSPILSIGKYCYIYPDVEITPSTEKMFIGSYVIIGNSSKIMAKDIGNRVIIEDNCVVHPHCVIYDCCLIKSGTIIPNKVVIPPYSKVSGTPGVDFTIQPLHNSYKKSIELEAKQLQILNPS

SEQ ID NO: 20985 - protein, 172 aa, Candida albicans
FWGVSFFKLFINFLNPTTTIMRLTDESKAFHFGVYSIVFQIPYGKVTSYGMSQVVSFMRLMNCKLTPKYYQGHIAYLLNKPQNSRQVGSSLKHCSFIISQLNEKLDPSNLDWLNVNELPWWRVVLSSGKISPREANGQYIQRDKLLQENVAVLEGHMVDMDEYGWFPEDINY

SEQ ID NO: 20986 - protein, 365 aa, Candida albicans
  UNSURE (157): Identity of amino acid sequences at the above locations are unknown.
ATLLWRGSYFSFSLAVFFSFVLYLNLFPLLLLYPFVFFNTPLSFVFNKEYYTMSLKLVPQQRRIVHTYGFNLTAFEFTTDPSNISPNIILFVGGLGNGLLNIPYLPELTDSASNEFQSTDCGSWSLVQVLLSSAYQRWGTSSLDRDPSELQSAIEYXRTERGGNRQKIVIMGHSTGCQDVIHYLTKTLYKENIPETSQVQGGILQAPVSDLEALLSGRDPTKHEALVQRVYDEYISKGKESGILPQEYRKLTWGVPTSAYRFYSLASKRGDDDYFSSYLTQEDYTKSFGKVNKPLLVLYGSIDEFVPEYVDKENLVSTWKQSTSSQYWSEHSQIIKGATHNLGDGSDAGVIEHLVSVVKKFISDL

SEQ ID NO: 20987 - protein, 67 aa, Candida albicans
QIFWTILIFYMLVIVIVCFLIRHDDPKLMGNSNWPVFTLCNCNFQPWNQSLAFYFQCCHFVCIIISG

SEQ ID NO: 20988 - protein, 229 aa, Candida albicans
ANYSECYCRQFEISLSNLMKGIEQCKIYPRSIYINNMKEFQNVLDDPINFLKKIPSINGKFFKIWALDSEAPLRFFINSNIKFDHLELFSFLNTLTLSHVATSIKLHDVRLNDYAIPGVKKLQLCEIPEDDRNQTYTFSSDLEDLYISTRESIQVTLPPNLRKLEIHAPQSSVDLVSEEMVNLEYLNLVLSNIRLLDEAEIIAPNLRTLILDCNNLSDVAHQRAGRPAL

SEQ ID NO: 20989 - protein, 102 aa, Candida albicans
TILRTPAGTPALAANSQIIMAAPGTRSLGLTTAVLPVTNTNGNDHNGTMAGKLNGQIDPITPNGSLIILVSISVATSNDSPFKSLVTLQAASATCNPRKTSP

SEQ ID NO: 20990 - protein, 93 aa, Candida albicans
TLLSTTAVPNSQPIMYIPKKYLQEDWEQVEYLIKNYPLATVVTNDENGTIIANHIPFVLKEDPESGKKYLIAHIAKTNHQLPFIFKTARQGTM

SEQ ID NO: 20991 - protein, 82 aa, Candida albicans
REAYKAIQEFIFPGLILESMHPSYFGVRPKIYSLEENMKKFADFEIKQEPGYPGFVNLLGMESPGLTASWAIGEYVKDLYHK

SEQ ID NO: 20992 - protein, 84 aa, Candida albicans
ILEIFFSDNKINGFSNSTLPVLVLVMKYGEINPRSNFIPSVTSNSSSKVLPSLTVITPSLPTFSMALANKSPICLSPLAEMVAT

SEQ ID NO: 20993 - protein, 115 aa, Candida albicans
IFDDILLPSSIAFKIEAKLSSVKTISEASLATSDPFNPIAIPTSAFFKDGESLTPSPVIAANFFLLCKASIIRTLVFGAQRAMTKGKTGNLSISSSLNASNSLAVMVIALTTSSL

SEQ ID NO: 20994 - protein, 73 aa, Candida albicans
TISVKSSVIKIISEASRATSVPAIPIENPTSANFNAGASLVPSPVTATTSPAFLNVSTSIRLSSGDDLAKTFN

SEQ ID NO: 20995 - protein, 114 aa, Candida albicans
ANRKKVDKATKVNAAILVLNWKVMKFCMLLKIPLPSSIALRIVEKSSSVKTISAASLATSVPFLPIAIPMSANFKAGASFTPSPVIATISPLLCKAFTIVTLCSGVVLANTETS

SEQ ID NO: 20996 - protein, 71 aa, Candida albicans
LIRPPINTISALSIAISVPELIAIPISALANAGASFIPSPINATLTLLLWLPPRRLCKSVMTLSLCMGETS

SEQ ID NO: 20997 - protein, 127 aa, Candida albicans
HYHYFTMPLLYKPAAEGKDVKPAQIPSPGNNSFLEDTFTSDAPKDKQISCGFYRQEKGEPLVYTYDCDEMKIIVEVSGEFTLTDETGKKVSAKPGDVFYFSKGTTITFESTDYALAFFTGLRPNGAA

SEQ ID NO: 20998 - protein, 149 aa, Candida albicans
CRVQHPFAKFTINMVLKDCKLNLKLIETISSYDTQQNNSNMTEKDLAGQPTIQSVGSHLQVQDHEVNLQAIISNPLSIGEVATTLTESQKWFVLKRLHFDALVSLEELPPQASFIFEKIEQMTTEEAVEILRKAIEEHATDVNIPEHDL

SEQ ID NO: 20999 - protein, 189 aa, Candida albicans
TMTMTMTVDITGCHKLLEQLYHDTINQNTNLMEILSIVKSSTTITTTTKSSSLPTIARGLQTKHSKLLSLINQSLKNLQSHPTNEKDIFKSFINEFIIWIDGDNTLNLFDKYSFELKSQKLCDSITERIINSPIDNLINLITFIDSCEYHLHNPFILDKLTIITKKLHEIITNHDNDVYYKKLNNILFS

SEQ ID NO: 21000 - protein, 498 aa, Candida albicans
EFDIIDKFIGVNGMYLLNINRNLVLKVSEMKPMIVFRFNETTSSSTAAAAVAAAGKVSSFASEDKYGLNHNQEIGNGGGGGGSPIISIKNYLSSTSISSFFDKFANIWLKQVDYDSLIHAVYCNVNSQDQKSSYCLKIQNQLIHILPVFKKKLESSKEVKNNNDNGVGYDYTLDMNSIRQNHSTTTRFSKMEETPDTDGNNDQEIQTQAIRQLHDKLRSQKDKTKGVTLGLAHEPKKTIEKIDEKLDDKVDSKFTKIIDTKDSLKIKLDDKKTTVLKHVSSKLDEIDDKTDLLADSVKRKKHQFTTYKLKPRLFEKKKSAITKYEHIGVDETYDDDDEEKEPSLEDCDDIEDENIRKSSIYAVGNDNGDGGGNTNKPYIHKRNQVLESDYSSISLANGIPDEGIIIPLSLLKFEQQDQKQDENLRTLNFPPRHKSFSQIINLQTGQKYRKKRQIPIMDDHDTKDNNKNDKDEPCQPITWYNIFHYSIFGEPKFCNEDN

SEQ ID NO: 21001 - protein, 118 aa, Candida albicans
NEPTVWTHRRNDCYVKFGFMTVHHTSYVLYLRAVSTAIEGVVAIFLMGIADYSNYRKLFLIFSILVYGFLALPFIGLTNNYYQTLVLASILYSLLMIDDSIYQILEGSYIPLFMRADK

SEQ ID NO: 21002 - protein, 185 aa, Candida albicans
PKFSKFLFEELSQKQNQKSLQSLYQFMWILNNDQLQNLLTICQSNNFNKEDQELFFNVVKTCIDKRLSISFFDFKKIYELNNSDKEEKVLTQRKELLTKLIEFDLIEFDNDNSGEDIQLNSIIDEILSNNNNQDYFLIESMVKKSSNLIVSKLMIKDSQDQNINHLKCLVVYSMAKQKQKQKQKQ

SEQ ID NO: 21003 - protein, 60 aa, Candida albicans
AAGALIEPPMSLPTPIAEPPYPTIAPSPEEEPPLDNNKLKGFLVRPVKLLAESRCIKVCG

SEQ ID NO: 21004 - protein, 175 aa, Candida albicans
RSATHGPSYKHLANSSNGSISKDTNSHPIFSNLATASWYNLGFSFSPYHNKLVGTTTLGFLPNFNNGFFGIDLENSSCSSSSAIILNVSCASCKFNANIETQSSDLHAGTTPEHEKTPFVGFNPIRLFNAAGTLPDPAVSVPNAIGTIPLATTEADPAEDPPLTYFGLNVFGVIP

SEQ ID NO: 21005 - protein, 165 aa, Candida albicans
TKMKNLRNQMDAHQSRIMEGGIEEELHYSMKTLNTTIDRLVYETRIVAKRIDELEQDFKLYEMKLNDECKSKLTEIIDKVLHLKQFKEVFTSPEERKQIAYKLTGDENYIKFDDEKESIGLLRMIVMFFYGIILSIFRFFHFNRDNMNLERIRQAWVILDPNRSI

SEQ ID NO: 21006 - protein, 408 aa, Candida albicans
GLSQPVVTTVEKPNTIPETSLLDWILISIGFKTPAKLSVSKRDAIISNLQGGNDWSQLVSDYFYLAGCEINFENCFLSLVLGTIIRHRFPVVATILNHYLLMKEALLLNLDYKGSNKSLIRLNQLISKVDGVSIFESTNLTTRLTNVFTNNRINANIVDGQNHVKYIEFYQRNINDYYAIVFNWRLLEFIHELNVTYLEQLNDDQSQVLTDLKIIEAFFGEQDNKLFGYYQLFTSILNANYAPYLFESLKDKVESSLEKFRIAYEGIDLTDHEIHNTSSEDEYEQESPVVYKYEPTLKSQKSLISSLNLVNEEEFIILTCSLTIYYYKNKEYDRALKLLNYLRLDNDSKTLSLLTFTSLITLINELIPGKIEDNVNLDLAIRICRDWLENPDSTQSMDEGAHNDTSGS

SEQ ID NO: 21007 - protein, 411 aa, Candida albicans
TAVFQPLWSKTRLPSWTQLFPEGEVSAKLPPTLFRNECPVVWEQHQKLSSLAYKKSITLIRDFDGTLPIPKHLSARGSDQIDSILLLTPLLNPIYPCKQTGSSQRLFTGEEVFQKFGDFLSNHPINKTKSYNVLHTTYTANGLTPLHESLIEQSKIVIFLTSEAGRNMYQIGIVKYVSILCGVNPLTLTKGLGPVQPRKPLIIVATLSPYDFFYNKSIGSAYLCCYDYTNNALENLASLLMGDFEAQGCVPGEKKFSTKHKKLAVEGRNENNHLSAKSVHKPKRRWLVDEFLMERDWQGLTKLLKTNSDQLTNDGFYKRLERLLSSTAKHQKHFVVRNSSLNILYGIVLTWVNESNCGHLVYILVDKSKRLQSIGKNLHLRAIRYLIKERTCNEIVLGYSFPLISLGGYHQ

SEQ ID NO: 21008 - protein, 96 aa, Candida albicans
SNNALANTTTPVVPSPISSSCDLDNSTNNLAIWFSKSICDKIVAPSFVIVISPSGLIKILSRPLGPNDVLTIDATDLAARICDLVASIPCFLSFLP

SEQ ID NO: 21009 - protein, 682 aa, Candida albicans
  UNSURE (91),(94),(100): Identity of amino acid sequences at the above locations are unknown.
EKKKGIIRATPTMDSNKERIEDLASLFLPDLLRPSTVNSSPSNATSPHASKSEDYDMGSVFLKDSKPTNAPSNSGLPSSFQEFLSNNNFIXRSXDMEDGXEERSQQQPQEYSHHYNGYMPFEMNPSVSQHMMSYNPGMQLMFQQPNNPQQQSFLSSTLPGQQQMVSNFPRTGSYAKYPGEYDEWFASTNSSITNLNGLYQQQLLQLQALQQPQPMPQPQNGAKDTRMDTQSGSSTPKRKKAKSRKRDVKNLEVQIDYKPSKLKRLLDLKQSGATSSNDYKIIDKDNNEVTIDFNGFLNGRFLTNDIDNNNYIFTQNESQRGEDELPKTVVNKKENPKVVSCYRRNYIQISANMSIRGFKNDSKLLKLQTSEYGYTTTRVIKYFKIEVLAAANNSNSKGVPIIIKNENKDIEREREKEARKMSLPSNYEYKADNVLPTYINTNEYVIILNDEPISNGMIDKYFVVKKLQFKNATPNNGSLTFQNYYHLKAKLSCIVADIYYDDYDIDVANDGGGGNNEILLAELVSEPIIVRGRNPSFYAERNDILIKGRSASSKSSFKIAGQSSELKFRAAADAEEDEDDGFVVEHEDEPEDEDDHHNHSEGDVAGQEDQLPHTQNGTGESPISSGDDDEKDNTQIPPLSYSTNQLALDVKSVDKYKYYPINSVYYLPRTNVVFTTGLEHPR

SEQ ID NO: 21010 - protein, 70 aa, Candida albicans
NIIHSNGKLEYDLWEFKNYIKMPMDPTIFFKRFNSLHQQSINHSFIQIVIHSFITDYHSFLYYRLSFTPL

SEQ ID NO: 21011 - protein, 61 aa, Candida albicans
WTRIRFRDFTKKQTTDLFHFILGRNMTVRKDHFFHKYTTFHTVRVGAWESDNLVDNGRSKL

SEQ ID NO: 21012 - protein, 99 aa, Candida albicans
YKYKQKIPKFRQMLLDLKIQNPHIKHSNCILIILTTMPLQNENLAPTKIVEVRSYTIKEGKKYYVVRLNNYLHKEISEKELKRLSPVLYYKEMQLQKEE

SEQ ID NO: 21013 - protein, 181 aa, Candida albicans
AAGDIRRVWPHPQWWKNSSIPPNNQGSNLLDKYKMLKLILQLKIYVLTDQFELIIDSLNKFAIHEKQIYLTPYLLDQTLLIENMLFKKLRSIQKSSTTTTTTTTTTTTNNNNSLDDVDDQESSSSSLLLLLGEGKKSLMKLRHFIGDVKLMLENDENEIMELIDKTIYILNQWKDNNNNNR

SEQ ID NO: 21014 - protein, 61 aa, Candida albicans
LIIEKNSFYTYIYIYIYIYLYLCTYIYIYMRKIKLFTKKKFIKFNLNGKQYYLLLLLLSFH

SEQ ID NO: 21015 - protein, 74 aa, Candida albicans
LSSVSKEYLPIGTIYTIYGCLLYFLGVFKSSRVDVYYNPDKDMEMFTTSGDFVLFLTILSLCCYIALLVLLLRM

SEQ ID NO: 21016 - protein, 77 aa, Candida albicans
HQVQLKKLSKEEVLRMYLYDCYFFWINRRLLTLLVIDVQYVEQLKENVTGIHRVQIVLKEIKNVFIPMLTKERNVIQ

SEQ ID NO: 21017 - protein, 216 aa, Candida albicans
QRVLQQEQQQQQQAQQQQQQAQQQQAQQQQQQQQLLQQQRLQQQAMIQQQHQQQLINNLGARQQQVGLSTTTNQMGPPGSNSNNLQSNMSPNNEQLQSQARLQQLKLQFQQQQQQQLQQQQQQLQLQQQQQQQQQQQQQQQQQQQQQQQQQQQQQQQRQQQRQRQKKFQRQLLTLSQRLPVINNGQPQQQLQQDQRPALATTKSTYSRKQQQQQQY

SEQ ID NO: 21018 - protein, 154 aa, Candida albicans
  UNSURE (38): Identity of amino acid sequences at the above locations are unknown.
WTTATTTPTRSTSCTGHHKINLLQETTTTTTILMLYHXELHRQSVDDYQMNLLQMENQNNSPRTKYLNNQQTPNSQKQQTQLQLQLQQLLPFQPPAQQPKNSTTTSTNTTTNRAQKSSRKQQPKNSGTPPVQPPPQQQPQQQPQQPQKRLTPPN

SEQ ID NO: 21019 - protein, 148 aa, Candida albicans
SPISNCVQVTRTTVFCDFRAVSAPRLIPNSHDRVTRSIFTLWHFISFNTFHSGIFTIVSLFRLFGLKPDMTNHQQEDPALSSTNEFNSSSGEDSSSDSSSSSSSEEEEEDLMITKPIYMSKTTRNKKGSLNNQITNTNEDKGQLFSTR

SEQ ID NO: 21020 - protein, 80 aa, Candida albicans
LSIKNITWFLNEITHLFDVILPLLFPLKAKLVGHVDTVLIGSSIETRSVFYTIHDFVLHHFFKTQFDFVLVGGVAKTSIV

SEQ ID NO: 21021 - protein, 172 aa, Candida albicans
RRHRKKLLEHLKTHKININSINFARPVPIDGTGMTYSSSGQPLSQPLHNGIKKEPGSNQTHTSQLSDLSLQLASSRDTDNKESLNGTSGPGQPFNSSRFRINVVKFLTENKLSMDVLKSNSFRQLVYDLRPESVNDILEVTSMYDAFLECTRYSPAEPGNTDSNLRVNGSNT

SEQ ID NO: 21022 - protein, 60 aa, Candida albicans
MTTRNMKTSKNKKITARGFTRLKFLVNLENMIKLVILKIVEYITMAIVLINHFILNGGIF

SEQ ID NO: 21023 - protein, 228 aa, Candida albicans
FNNIMMSHQRLINQQGNTSTSTSSSSAGGCGGGGDAESIILNKESFPSISLKEKFTQMISNNFQKIPPFRIKWFISTIAIVIYSTIFNITNLIMFSKFTKNFNLVNPLAVIFLFLDVFIFLVVIYEKFYHHDNTKFTNKWSKYTYIIVCKILKKLLWLILLIACIFHVVLISIGKLSNPLNVSDAQMDILNMTNHEKTGYFVINLINLVFNGALLGICLAPAGAGRIR

SEQ ID NO: 21024 - protein, 65 aa, Candida albicans
LQLNTLFNLYRTIKQQTGGTQEIRKRDNPQISIDHQLFLYSNLIFGKVLFVGFHISPCYFGFGFP

SEQ ID NO: 21025 - protein, 66 aa, Candida albicans
FFFVTKSFEKWKNNKEINLLFSVFVKHLIFYNTSRVKLHNIGCFDFFFPTTTTFFFPNVYITMVTR

SEQ ID NO: 21026 - protein, 67 aa, Candida albicans
FFFPNNHDIFFPKCLYHDGNQVNNLVVSRFVVVPDLVNSFYAFFSVTKSKEHHKRGGLWIDFSFYFI

SEQ ID NO: 21027 - protein, 63 aa, Candida albicans
LGNTWRIGLGPGRVCAAQGGRVRKFKKIKNTSSIQVCMYVCMYVRVYLHKIFTTRPGSAYGYR

SEQ ID NO: 21028 - protein, 83 aa, Candida albicans
SIINLCMSEIWNQLKCLITNQDLNTIKHFPQPTTTTTQQIDCLSILNYPFIPTSLLNYWNRKTYLEKKSLLLQISLILSISLY

SEQ ID NO: 21029 - protein, 79 aa, Candida albicans
FVRSLMCYFVMFLKNNNNNRNHQSAMYLIDGYAPIHPFLEHFFLKKFFPVSFSVTVRFNKKANSFLVICHGFHLRVSFA

SEQ ID NO: 21030 - protein, 203 aa, Candida albicans
LDLIVNSNIKFDHLNLSRFLSPLTLPPIATSIRLNKTILNNYAIPGVKKLSSSVKSDDERNQMYAFSSDLEDLHVFSEESIQMTLPPNLRKLNIEVTLGSVGFISEEMVNLEYLLLKLPNIQSFDKTGINAPNLKKLVLECESLSNFDGLKQFPYLKHLEFSEVSFSMSLFDDGSFSELDTFICWGCDIQNTVDFDSSLLIFT

SEQ ID NO: 21031 - protein, 64 aa, Candida albicans
AERRNKPQISWLELVDTFYFKLVVLSKEIEYVISLRFCVDDQKTYILEKLKPETKIRLYLIYII

SEQ ID NO: 21032 - protein, 101 aa, Candida albicans
  UNSURE (15),(29): Identity of amino acid sequences at the above locations are unknown.
LFDVSTTKKIMRRSXPWMILWFLVPAPSXFFLVFGCPLYYLLFLTVFSSSVEGDHTFSLLSPLNSLISAFAFGLEIRLSFHGFFNMSSYQFNTEESCSRMS

SEQ ID NO: 21033 - protein, 242 aa, Candida albicans
HVPILSGNSNYSNNTTNSLPSVSNLPHPNWGSTNGTTGSNGTSGGSYQQNSFHQRQNSVVSDFLIFSNSDNRKDIKSNWLKGVLNDNNNNNNNNNNEQQQQQLQDPKLASPAPTLPPVSSITGGGTSNGNDLMMVDNMENKNDVSQSNVINDSNNNNGDKMVNKLNFQSIELHDNNNNTPSIKSTHSTETIQTTMVVVNKLDPPPLLTPTTTNTNTNTNSTATTNATGYVSKKPTINNLISQ

SEQ ID NO: 21034 - protein, 233 aa, Candida albicans
RVISFVELIRLFNNTVMNNKENIPTTPKSKESRIISAVSPINNQMLKPISPNKEKNQIGKLNFLETDNLDEHFELVYTTQEEIRQRLYNIELTSKQTSVDLGQLFDRLKNNNENLNKLLRNVVSYSEEVMTEGNATKADMEKILTRLDKLSEVRSKSESLKVGISDSSIEEIREAIGQVFSANQKNHGDADKLTILKEEVSRIKDIISKHNEVVSSQLNLHDIFTTGSKVNAL

SEQ ID NO: 21035 - protein, 129 aa, Candida albicans
RYILENPAPRVFTFTTQLTDYEDQWIFNNSKNIVPLIQPPFPVLPFSRHYMDFIGEYLPALEGMSDSNSNLGCGSESGCGSRSRCGLGLKLPKFKVFDVQYKVTLPIVSVLKDITSIPKNTGNLYYKPK

SEQ ID NO: 21036 - protein, 173 aa, Candida albicans
ISAMSSLSIYWERQELSLMYVLNYLLAVGSLRKLLESSQLYQKELSFLVNSVSLSLSKDIDKLASQTTSTRSSMVSIPQYNMEIERKLEIEKKLASSKYKYSSLSSVIFNGSYKEKLRLVVNFGESLLAPNLLVKKLKNKSIDNNDSYVESNKVVERLIHAMNKIEDDLLAVL

SEQ ID NO: 21037 - protein, 257 aa, Candida albicans
PAPAATAAAAPQQLQVQPAQSTQPPSSQQQPLLQSTSDISPTQIFDTYAKRDSFSDTTTTSTASSNTMTTMISDKTTLQMVDDYFENDCHERVKVTMKLLNERFFNEEKFLSDAYQLPKFPIENSLRNYQLILVGFKAGRIDVFYLPTTNNTNSSSSTTPISQQSNNDLMNLKVGDLVIVEADRGRDLGKVFKMNISIDEARLLKLLQFQEQQAALKEHVDNILDDISVKSLSDQQQQQQQQQQSRSSFHHALQIHV

SEQ ID NO: 21038 - protein, 108 aa, Candida albicans
TLTACCLLLARAWYLMSYASPTRHKLSSLFFFCSHRVKYTCSNILDTINIIIITHLKTKLKKKENGKENGKDNDLHTYIYIYIDRYYAKKENVFVYVYVCFYDRTERK

SEQ ID NO: 21039 - protein, 60 aa, Candida albicans
  UNSURE (1): Identity of amino acid sequences at the above locations are unknown.
XPPWGLTIYLLTGLYWGLGIFEWHWLKSVEKMRNIQGLNINVKVNPPRNWVIYSNNLWAT

SEQ ID NO: 21040 - protein, 61 aa, Candida albicans
RTIKKSNNQLNKVKTGTFSIQVQIEREREIERKKKFSSNWNLVLFSFISIYLVLIYYQHLD

SEQ ID NO: 21041 - protein, 61 aa, Candida albicans
YYSFSIHSQLYIMDDAELNAIRQARLAELQRNAAGGGSSTNPSCSFVFTTATGRISAYVRA

SEQ ID NO: 21042 - protein, 64 aa, Candida albicans
LLTGFCTPVGEDKYTMIQRKKKHQIKPKKKNINLNTNILLIYFLFFKNSKIQKLIIFQVSNNLT

SEQ ID NO: 21043 - protein, 144 aa, Candida albicans
  UNSURE (129),(131): Identity of amino acid sequences at the above locations are unknown.
INQYRHHHHHCRRHCRRHCRRRLHSLILSILLLQLFNTLELFTFGNYQQYLKYKEKYIDLDESLLRKLLELTLITIDFENINQIINYQDIKNHYGIEINNNNNNNNNSYSGMIISLIIKLNLQNFGKSXQXYFITNKSMMWKRN

SEQ ID NO: 21044 - protein, 72 aa, Candida albicans
NTKLLGDKGNHNNLLKKLFLNQQGGESSSSSSSSLMKILDKIEIEIDKQKLQTAIIAMSAMIIGYYLQRLTN

SEQ ID NO: 21045 - protein, 61 aa, Candida albicans
HHAIPWRLGRVRLDIENEKTKSKKQKKKRSASLSPMVLLEIINPLIKKIGLYGEFIAVHET

SEQ ID NO: 21046 - protein, 61 aa, Candida albicans
HIIILYTHSITTTTTSLTTATTSSKTNFSFITFETIKQPIRLRISSFMYGYKLPIQSNFFY

SEQ ID NO: 21047 - protein, 100 aa, Candida albicans
GVVNDHKSEVSLCHSLLTRWMQFAVASICSTQRHHCNIILGFFVSFFNNKRIKTRLKRTERTLKELFTHHHGTTNAITVTFTHNKSMENSRTNRILITWS

SEQ ID NO: 21048 - protein, 101 aa, Candida albicans
KNFLHITMGQRMLSLSPSHITNPWKTPEQTASSSHGHDEVISPETNTYSPDFSNYTRNGSSYRHVDKKSASPPTTTFDNQTLQENNYDNTNNQQSSEADVS

SEQ ID NO: 21049 - protein, 62 aa, Candida albicans
VKEEVVWEKSSPKKNKKFQWLRNNQNESILTTARDTFQRNGLPYHRKLSTHVVIDFTFIKNY

SEQ ID NO: 21050 - protein, 271 aa, Candida albicans
VKRGSCQPRREDDTGNRSSSNTVTSHQRESVPPASEPPTSPISKSVSQKIPVPPSAIPARVSDLASSEFSHDSSSIAEDDEESDIDRHQVSSNVLENEIGTDKTINLLKDINAEIEGAGYEADLSEAAKNEERKEYGIPQAPPVSSAPVPPPPPPHHPHPHHTSDETEVPEVDSEQEEPHPPIPSRAPPVPVSVPAPAPAPAPAPAPAPAPAPAPAPAPAPAPAPAPAPAPAPAPAPAPAPGPNSAPAAAPPIPESNGTAPFQTTHVEEDD

SEQ ID NO: 21051 - protein, 92 aa, Candida albicans
FFFFDSCYYLRVTQRHQIKKKNTDFSRKKKKGKKNSFTVRINDEVTPYKNAKLTDKERDNCVKFVYLNVWSRKATFHDHVDKNKSNLIQSIR

SEQ ID NO: 21052 - protein, 95 aa, Candida albicans
STCTNILKHSTNLITIEIGLNRTYLETNLYTGGHTIFFTVDPQLQKSGTQKQKNTHKSILLGVCSMKSVLVNKRTKLTVVYITSKKPLKRSVKSK

SEQ ID NO: 21053 - protein, 63 aa, Candida albicans
PTRRPIKLWFSKDSIIKSFVLNAQFVATRSKSLNRTSFMEKLLSLNKLSIFFFQKRKNINYIR

SEQ ID NO: 21054 - protein, 125 aa, Candida albicans
ILRKPKFYWSTGWLTWNISLSNNYVTPTNINMSVSDKYPELVRQFFLLDEVKEILPNYPKYKILLQTPEVDREYYKNITSPEFIRQWQPEVLNHYRNNWTEVIPLCAIVHDRTIDAGLRIRNFSI

SEQ ID NO: 21055 - protein, 199 aa, Candida albicans
YNQQQQQLTQAHTYIYIYPINSMSLNNPSQDLIFFKDNSLISDKIINQETTTTTTTTASNNFHSYLSVITYNQSTSPNWLINGLIEDTLFGNATKSLNNHESYHQMKKKDIIIKNKKIMIISFLHNKEFYIKNCKRIGINLEEKEQQQPFQFIDYFNDLFINLIKNPNDSVKDINKMCDNIINSLNNEYKDDVDVIIIE

SEQ ID NO: 21056 - protein, 205 aa, Candida albicans
RNAVLPRRGEYSALLIIDVATQAFETVYKSLSCIELFFNHYDNLKKLLIPSLVVRTKSILDSFAKIEQFLKLTFPVDKMARGEIVTFDESTFENVRRVEKVTSGIERESIFLETFFLAFDASLTLYTSILLGKGILKRDVPPRDCEIISRRRICYQAAEHVVTIPLSEDSPNKSKSAMEYLGKYIAYIGVLLLILISVVFYRLCK

SEQ ID NO: 21057 - protein, 60 aa, Candida albicans
YKKGNVVVVVVVGVFTRHSPKMFNLNCCYINTSNTITTTLFLFSNTFYSKYLFYLSDTTI

SEQ ID NO: 21058 - protein, 76 aa, Candida albicans
FRFFIYLYFFFPFLTVYLMLLFILSSIIISIYIYYIFDSLLSFRLMFYIYIEVLSRLFFVKFIEIVQYIITHLQFQ

SEQ ID NO: 21059 - protein, 95 aa, Candida albicans
LTDNHRHLFLLLLFNFPFPIVRQHFYLSIMSKGRFLKPLQEFLTSKSDFSIIYNTSTTGSTSSFINPTTQRVCILDSSFHLPHLGHSCPRVQIPC

SEQ ID NO: 21060 - protein, 100 aa, Candida albicans
HFLLANLNFEILSNNFISLTASLEQSTEAFNNQLFFSFDSTNSAREKEKSKDFFFCTPCKFPLLLLLCCCLILVLLLLLLLLVFPNITCCTNYFLLVTIS

SEQ ID NO: 21061 - protein, 84 aa, Candida albicans
RCNNKQKKKNITSRDKKIKYSATLEQLEIVTKRSKHKNRIKKSMFQLLLLWSSCRISGILKELTKLGYCDQKKVVCAASNVGKY

SEQ ID NO: 21062 - protein, 98 aa, Candida albicans
NEHIKDNTVILDNIIPYLTFFKSIEFPELALTLAEAFDEPELLEDDADDAEESVKVLTSELAVNEPMAFVNWEDTLAYTNWEVTDALIVWTESLAIVA

SEQ ID NO: 21063 - protein, 87 aa, Candida albicans
TIIFLDYIITHSCLHNRLFLEKQKLERRRRRRRRRRKNFKIFQHFIQNNYILDIKYFSLESSFNLIRHIYYYYYHLSPFPPNYTTID

SEQ ID NO: 21064 - protein, 80 aa, Candida albicans
ANFKIIPTTTISLFLFIQLSVWDTSSLTNITMQLAVSYIILMDTPGFITVGRALDHSWLVPLTSFLVVTHGPRPTPLSCS

SEQ ID NO: 21065 - protein, 172 aa, Candida albicans
PPLWAGMVHPVVKTRWVKGSKELIEQQEFEEDGTPKPYFFEKYNVQLEIPEFVDEDTYDLYMIEIKEYESKMKEERARREKERKEREKRDLEEKKKKQQQQQQKSQQNPQNQIKDDEKNQDTRNNTDKKDSEQKSEDKPTVEAKKETDEKKDDVVLKDNTNETKPVTETTKS

SEQ ID NO: 21066 - protein, 70 aa, Candida albicans
EDVLPTFKSSYLSSSIMVVNQRCNKEVLQNQYTKKSKLIVVKDQESKTVVKKILQTLLNVVIIIKFQCLE

SEQ ID NO: 21067 - protein, 339 aa, Candida albicans
PIFALPSGLLELLLHVFENPDRGTGVYVTVARGKNLVGDNLPPVFIHNVIGKQLNLLGKYPLHNDVAPLILFACIFLVITVLHFALFLINYSRGHYFMLNLIWAFTMMIRMLSFILRATWAVNIVNVKEGIAGEVFFVIPDVLLVSTNLILAQRLFTWRHPVGGTRRLFWVFMISLYLLAAIILAVAILSSAIPYLYYLSTERFFVYINLNRWASIMVIVYSLTATSLIGLSLWLPTKKDENRYTYQPWWIESFAPFYFIKKGAAQEAAETFMKRNSNHRHATRVIAATHHHFKVVKGLSNQRGDLKHNVSLVIIIISYCVLINCFDSCLGPMGWKIRV

SEQ ID NO: 21068 - protein, 105 aa, Candida albicans
YILIYFIVTMLVQFQQLLLLLISIIKLCQADDNDNSFFQPVSQPSLNYKDTGNRIGLLGSFDALSFYSFVNSSQIVNDPDNSVSIFQKKRDVSNSSSSSTSFSNN

SEQ ID NO: 21069 - protein, 197 aa, Candida albicans
YKHILVKIMPRIKKELIEVKQKQQRSILDFTTQQRQQQQQRQRQPNRSSQVVTIKSETITNTTTENSSIVYCPICNEGITHLDLRERTDHVNTCVVPVTFVEKATSNSTTNTTTTTTTTTTTTTTIPVKREISEVKSEETMMETVVPKREFNNSLSSILISSSSSSSSSSSSATEKTNSLITKTRKIDPDNKLKYIN

SEQ ID NO: 21070 - protein, 292 aa, Candida albicans
AVCVKNSLEIWQLNTTLSTKVFVNSNINCPNLEKLSICYCHSLRESPLTFSQFAAIDFGKLIQLELKLNCFHRDCDCINQFYNDLTKAQHANEFNNLQKLSIINYKSKNSSNNLCQYNYVINCQLQSIFRKFPKLDYLYFNLNEFTKNDQFKIIWAKFAESLQILKNLKTLIIYDFFNYWLPSMKSNQATSEILLNNCKCVECNQRTSAFNSMAEYDAANNYVHNFKNYTEPELSAESGNEYQPILLNKKCNAKLLWFIFSQLQLQQFKQLPIYSMNLSYFREDKELFSQFQ

SEQ ID NO: 21071 - protein, 103 aa, Candida albicans
LSFCFFFHTTINYNFIILVWISTWKEDNLTHPTLETEQAVLVRLPDPSFIWFTPHFQVRTQQILNQKRVVHRKTIPQNLVPHNQIQYKIKTKVKTRVNYHNKN

SEQ ID NO: 21072 - protein, 314 aa, Candida albicans
LQLHHSRLDFNMERRQFNTSNIRNGTGRPRKTPRSKLYMVYPPLSGEDSTNPEPEEGSSQENNPTEPSSSQSNSVQNQDQSEDQSQLPQQELNTQQELNTQQELNTPSPRASNTSTETPAPLSPIQPGIRNIPLGLLLPQEKVGRLMGYPFYRDFNFTLNPERYQKLIYVFQILKNAARNHRNGASLLKKYFLLARRSKRTTDMFVTTIEEMRKRLLENSRKRELEEAQEREESNKRQHTESSAEPNAELSTESTTESNAESGGEPNAEPSAESTTESNVESGAEPNAESGAESGAEPTAESNAELKQRIWESS

SEQ ID NO: 21073 - protein, 69 aa, Candida albicans
LLLLKCIIRKIQYAMEVETGNILIGRQLVWDIPLISVSELTLGISNSVNNCKICRAINTSCTTCRRLFY

SEQ ID NO: 21074 - protein, 76 aa, Candida albicans
QTKITKKKFMEVIISIDHINIINPKTTNAKYLIFSISSLLDPFSYEMVTAEEEELVGVMTEISMGTSDGIDKLEPF

SEQ ID NO: 21075 - protein, 106 aa, Candida albicans
NTQAITMATSTEVVLTLTSVSGAKPSVANDATNSVHTTDYTTATAGVQNGSSLSIPSDVPIEISVITPTNSSSSAVTISYENGSNKELIENIKYLALVVFGLMMFM

SEQ ID NO: 21076 - protein, 60 aa, Candida albicans
  UNSURE (22): Identity of amino acid sequences at the above locations are unknown.
YARDSPIQTPYSSHIGDFKIGXTVIRVDPEKVVAIVESISVISSHQTLVVTNNQEVLPTI

SEQ ID NO: 21077 - protein, 298 aa, Candida albicans
LHLYILADPILKQVPLIKNPAFQPPRPITLSNNYNKLIPTLSSTVVPPKLNISDTEIDSWLNEIRSLREQIKNKQTNDNNRQCTKYENWIREQSNKIAPGFNYTVMQPQKSMRNQERKLTTRKEEEEQEEEESDDNNDNDKDNGSGYDQAQLFLRSYWYRRASFDCPLYTLFAGFLRVLFIIYFLIHVFIRCGFTCCAAPLGVVPSVLIVFGVVCFLSVPLLIFRFWCIIYFVFRFSLLFVMTFFSLSFWSLFSLAHRIRFYFLPLVLLISFVLSFDFSNSLCFWHPVTLIVLFALSL

SEQ ID NO: 21078 - protein, 73 aa, Candida albicans
EAEHKIDNTPEAKDKKRHRQETNHAKNNEDRRNDTERSSTASEPTTNEDMNQEIDNEQHPEKTRKKSVEGTIK

SEQ ID NO: 21079 - protein, 65 aa, Candida albicans
IRVEWCLTHDMWYLDKLSYCEIEFDRVCRRDVLLMLMISFFKFVLPYKSQSQKKKKIELSTKSNL

SEQ ID NO: 21080 - protein, 81 aa, Candida albicans
KKKQHHLQSKMIRGNWSLADEFKKNEKKQISKIQQRQRDNHKLEKLKAIDPIHLYYKIDRLDQTPNKSEKDNSYLNKLKED

SEQ ID NO: 21081 - protein, 124 aa, Candida albicans
FLFNGLSCCIMCLLYFRYAFLSQIYLLPVLLFFLLLYSLSSPPPPLFVLLNSFIITIIIIVIFKVLFNIIANITAITTISLSRNEMKFNLITRFVEIFPFLFFLCYLINLHIKVLLLFLLSMLS

SEQ ID NO: 21082 - protein, 114 aa, Candida albicans
  UNSURE (46),(75): Identity of amino acid sequences at the above locations are unknown.
SFFLQPHDNIQQQTTQTVNKRDKRDKRDKTSVTKRNNYSSWPPLSXQLVLQLKLLTIANYYIYYVFSFLPSFFLXHQFFIDFILLLYYYFYYFTYILLFYACVISHFCFQHVNC

SEQ ID NO: 21083 - protein, 69 aa, Candida albicans
IVSMTSYKKKITKNSQGFKPASNINKNRNQEKRKKRKKGKKELCKYLLILVLKNTISRETRTKNEATIK

SEQ ID NO: 21084 - protein, 76 aa, Candida albicans
KVVEKEEKKRKKIKENNIQFQFGFKVPCLKIGDLLMKSSSVQKRAATTITLVNQSIYLSSKLKKGKHIKKKTLPSL

SEQ ID NO: 21085 - protein, 93 aa, Candida albicans
LNQSKVHDRICRTINFNSSENFFFLFFFCIAFELIKHAHRTRTQPRTVTHTHSHTHTLTHSHTDFETIQQREKKIKLQRFTETRSEPYIIPKI

SEQ ID NO: 21086 - protein, 98 aa, Candida albicans
  UNSURE (92): Identity of amino acid sequences at the above locations are unknown.
CCVVCRVKIHKIKNKNKKKKKKHLEEAELNNVRNVKKICISLQIKFLCQTSIVIRVYFFSCYLICYSHCIYSYILTRSCFAIKYLQYLSLFXCIRSFC

SEQ ID NO: 21087 - protein, 62 aa, Candida albicans
IVYPHFTDQVIFLYPILSIFIDILFIMIKKPLATMPTLNSRRIRLVLTLGLLLLCLLKSTHC

SEQ ID NO: 21088 - protein, 104 aa, Candida albicans
NRRQRMKDRVKKKKKQKQNQSQEKIGGKSCKLFIVVSIDKLLGGVVVLLNGKKIRWMIIFNLNYEENMVKANKKLNLEWTQLNNSVINSFQFIRIYLQVQYYYF

SEQ ID NO: 21089 - protein, 107 aa, Candida albicans
PYLSFVDVYFIFADPLNMLLPESINSQNLVKRIVYYSSYDDYSGWWKWRWLLWLLLLIPIFLTIFLIARRGRQNKVVAYNNPPDPQANEAYYHNNQFFTRRGRTKLG

SEQ ID NO: 21090 - protein, 123 aa, Candida albicans
PIGDSYLPFICSSPHCKTSLAACCVLSKFISTNATSAPLANKALDTTAAKPPEPPVNMTSFPSKRKLGTMLSYDQYAESIMCSENKEVSCMGRKNRKKNGDMSVSIYFLGGDDRLNVFFSGRL

SEQ ID NO: 21091 - protein, 62 aa, Candida albicans
PPQCFLFGKIIKIVMYECTERNVSSTEDLYKKKWAIYTSPFFFFLTNVLYPKSFIVLVKSFL

SEQ ID NO: 21092 - protein, 61 aa, Candida albicans
FTLLPLNFNKSDDIGVSIIPNILLTNDEYCPFTKKNVKLTKLAIFKEFSNPERIDVLLINK

SEQ ID NO: 21093 - protein, 72 aa, Candida albicans
YQQCGFLPSSGQSQQTNKHLLNSFNILSYQVNFQPNDYLPNSVNENDCMFCITGVRTFSAILIVFFTNLYCF

SEQ ID NO: 21094 - protein, 70 aa, Candida albicans
VARGFLPAPCGCKTIEYKVEDKLTCAKNKFSTYVYPYIHQLYQFTDVAEVHAHEHLSQVYDKVQKTLKQD

SEQ ID NO: 21095 - protein, 101 aa, Candida albicans
VMVVYLKFALNVMIIPLLLCHYSKCIVVFLFQKDYQADSIVSSMIFLLYITLYVSNFTKQKCKLFQLKLVKIFILKKKTPINFTIKLRAFLLLQLIFRIKS

SEQ ID NO: 21096 - protein, 239 aa, Candida albicans
IVPQLEHNHKSSMASSNDTFSIAKTIASPITTQPSLIVKASKDWVLPPRPKPGRKQKENTTATTNKESKPKKKYVKKSQRKKELLSSLNSQQQQALHCHEDLSANIDDLPSLMKNISIIDSENMELKSHLLSLIHEYKHLKDIVFKQPIDMFSHNTTPISTTATTTTTTTPTASTATSTTTTTSTSTTTPEVLSAISLQPSLSSVSSSNNNNQDDPLHQYSSIPSPGSPMSSISTPLPQ

SEQ ID NO: 21097 - protein, 305 aa, Candida albicans
NNFIFSFSFSCLFSRFFFLYPIPLKTYLHIHTFVMKLSTTTALAVLATATAINAAPEQQQQQESQFASKALTKREEQDIQELVQHINNYKTRRDAIDEEIMKRDYAIVTDVLAAINQSQLAPKILDYLVSNETFKPIVVNVTIATMKSGIISLQALLDALVSSNLAVNLVNDLISDCSLYVELFNAAKSVINDLASKVKGLISKGVSQLITRDETDIDALAPYVVTMEKRLDLDGVVDNLLDSLYKSGLATSVVKDILTNSDYIPFATDLFSPMIAGNPLILVILLMLSNNLVCLLDEAQNLLTL

SEQ ID NO: 21098 - protein, 75 aa, Candida albicans
TQNHDVVCPFTASSARRSPATGRSPRVSEEAPWNTTYIFCLHTMPEKTSLGVIHLSPGDIFIHYFFYSFLNSSFL

SEQ ID NO: 21099 - protein, 65 aa, Candida albicans
QPASLFNRQKQHIHSVPHFHIKAKAFILRIIVSASQPHQTPASQTAPGAGQPHPAQKPSCRLPLN

SEQ ID NO: 21100 - protein, 76 aa, Candida albicans
LESLAPVRDAFVEEVDVLELPLLLLAKDGTSKEDCIGGVAVVLVVAVFVGVLGDDVEEDTVFELSVSVDAIRIGAT

SEQ ID NO: 21101 - protein, 61 aa, Candida albicans
STRHMFERLYVIVVLAKLSVRDINVDDFFSGGGGSTYTSEAHECVGVVRGFSSFYFLSQDD

SEQ ID NO: 21102 - protein, 77 aa, Candida albicans
NHPLLPQHKECSGPEIRRISSDASVRSNPMVASEPKSPTPLDYENHNNVTNFSPTTKTPNKIPSLFTPDPTIFRIHF

SEQ ID NO: 21103 - protein, 63 aa, Candida albicans
LPVCVAYLRLLIHILMKLNLLERVRLYPIMIQTIFTMEVCLLWMKKTVAKMIILAALTLLWRH

SEQ ID NO: 21104 - protein, 78 aa, Candida albicans
SSRLCCIFETFDPYSDEAESSGTSEVVPDYDSDDLYNGSVFTLDEEDSGEDDYSRRPNVIVEALGLLSDYDDGDDTDS

SEQ ID NO: 21105 - protein, 88 aa, Candida albicans
VIPILLHSILVTNCIYETLTTIDLILFVNHLLNRSETKSVTTSIKASLINSNEIRITTRALHYFLSIGCDVSIEHSYNLLPVIITFIM

SEQ ID NO: 21106 - protein, 63 aa, Candida albicans
FYVELHYPLRNFKMKKWSRFSQKWNKIVLGSLRLIYALLSDLTCEFNADESHLYLLIPCPTTT

SEQ ID NO: 21107 - protein, 124 aa, Candida albicans
ICLFNLNLLFFATMSTSNKRQSNQSLSSSYGSIQAESASPRPIFRTGSKTNTSNILSATTTTQNNDTSGPHSPSSLTSGHPLLNNNSNNDNDEIDDITDIKPEDELNDYHLHLLNYKSITLEYK

SEQ ID NO: 21108 - protein, 92 aa, Candida albicans
EGKKDGREKERGREQRERAEKGGKSRGEEREGEGGKGGELGGREEEEEREGTERREEEKEAKEREGNRKKNPQNPATRGESGRSGTRKGKFR

SEQ ID NO: 21109 - protein, 119 aa, Candida albicans
RRVGEVGNEERKVQVAQFDYPAIVNLKDQDAEIAKKTITSSSSTTTTTTAKKDKKTTSTTSASSTTTTSTKSNSTSSSSSSSKKHKSETASITKTGGADSVAAAAAVGGPILAALALLL

SEQ ID NO: 21110 - protein, 94 aa, Candida albicans
WKIQLQVILVGELELLIKVHLLLKSYHSLFKPRFFFLKIFIQLDFLFCILLVISIIQFDYYYPKMTLKNYVSSVNIQIDPNSTLNLSFLIYFQL

SEQ ID NO: 21111 - protein, 256 aa, Candida albicans
IHYIQFRNLNQDEEDKDNNSKDITEEEYFDPVQFESFMKSSIAKYRKSQNKKHLDPFKNITTSETNSEPKNQASNPLTLLYSQLISNPKYIDSQRNGQYPFSNIVTIKSSATTKQTELISHHKKLRINGAPITSESLRRNKEKCKCSIADEETSNKTLEDALLEQLNISDHDLDGDEVWNSSELNSEEDDYSEENTVDELLSSESSDLDSSSIDEYSPINSTNQYYNNFKSDLKQKKRDKLSGRNLDLGRHYHGQI

SEQ ID NO: 21112 - protein, 156 aa, Candida albicans
LWFNLLHYSNFSNRMYQSSSSKPKLNINNNSTTITINPNNTLNPLLFATPLNFKPAFTSTTLSTGFDNHIPKSYIVLSNNSNNSSMKTSKKLGKSNTKKTTNDPPKRKSLNEAIANYTGNKYLTHKERKRNRKLQEIINEDNQVPKEDIQPGLEIR

SEQ ID NO: 21113 - protein, 84 aa, Candida albicans
  UNSURE (21): Identity of amino acid sequences at the above locations are unknown.
WYFWAQPFHGDLCAYVSNKPXEKNKKRETVNKIRPTNKQQNNNKNNNNKTTIKKKLRERNNNIHSLSEQHLPTRQLSTSPPVRL

SEQ ID NO: 21114 - protein, 227 aa, Candida albicans
PAGTVFIAVGAIVGAILLGFILYHLIVSLNASKLAKKSNADDRKLYEKYQSNNTDAYGYSGVTPQTSLNNFTSDYGGSVSKLPLLNKSFANVNGSQTGDNSTIYQSEVGAAVTSKHDLTKMFVSPTAEVMQHKRVRSSHYNPSLTNLSFGGSTSNLGNPSLATNRHSQAVPNLYINQEVNNSDYSLSQHGLVAPSSQQQQQQQQQLNAPVNTKTLPSMYLEDLIDKE

SEQ ID NO: 21115 - protein, 93 aa, Candida albicans
EDEIAKQSTVNDTLHITFKEIEGLNQLYLQHNNPNLLQDPIEDDEETVIINEDTINQIVEKFELTNLKEDLLKALKQETKRLNRDIKVEDQVE

SEQ ID NO: 21116 - protein, 209 aa, Candida albicans
IGDVGDIEFQYIKPPKQSVWFRRPHALNYFKDGVLFRTKGERTSAKTELFLDLLYVGIIANLAGEASEEAGGKALLKYVLLFLPTWVIWADIKDFTNYYYNEDLSQKMYIFWILALLTLYINSHYALLNSTDGAALTIVPYILCRLSLAVSYFVYSFFIPEHRAHSRLYSAMVLVTSLCWIAVISVPTTVKIGLAFAFLYLEQVCFSIA

SEQ ID NO: 21117 - protein, 61 aa, Candida albicans
ITYSVSLSSFHLSLAFKQFYLYIYPTTTINRRHSIKSRIITDLELSCFFLLTTSHMNQIPG

SEQ ID NO: 21118 - protein, 121 aa, Candida albicans
IFLVLNCVFSSLPPLSPTISRQLTNWQCTYYITMVVKKNRFCPAPAPRPHFYFFLLTSSIQGKNLFHNISITTYQICPRPRPRPRPLTYLMSCDSPIIVSLNDLKTDEGYPGLKDEILEKA

SEQ ID NO: 21119 - protein, 70 aa, Candida albicans
  UNSURE (62): Identity of amino acid sequences at the above locations are unknown.
FKKNFLQFLNVYEILLRGIFTTSYTYGINPNPRMVYPVVILIFIGWIVVPNSVVLLLVVVSXSSLSLSSL

SEQ ID NO: 21120 - protein, 66 aa, Candida albicans
  UNSURE (47): Identity of amino acid sequences at the above locations are unknown.
RRLERGGKDGEWKGRRRKNEVEMGVKPGKRPTTGTEEVKEIWRNLEXTQRQINSPKKKQNSQTKKN

SEQ ID NO: 21121 - protein, 124 aa, Candida albicans
TITRKMQIKSFLLPIVAALLTSVSAADSSNKCSFSKTSITEATGISQLNACSTLDGEITVSGSGIGSIDLSSVKVLKAKLSILNSPSMVSLNFQPITNTLTGGFNQLIKATPFKIQFNFTPILP

SEQ ID NO: 21122 - protein, 155 aa, Candida albicans
LRICSAFIPIYYCPILKMSDILKANHRKVYGNVSNSSSSSSISMSPSGSATNKRSTRSAGDNRSKLSHDMVAGAASFEATRLFEDRHRRNGKPVSHAFARKTLIALAASEVDKLFEVKELTHLDKDQIKSEAIKAVEKEYETHYGGFHTGLEDPR

SEQ ID NO: 21123 - protein, 213 aa, Candida albicans
  UNSURE (210): Identity of amino acid sequences at the above locations are unknown.
LENGIQMPQFLITHHIRYAISSITSFESHCEDEEEEGDKMPSGFEEVNRRSVSPQNKQQIIGLDATRNQVQQSTYTALDGSNNTTSRDSTNITKHNNNNRNSTIQQVGRVNYNPNRSSLESQRVEAVACILERTGSLARDSRRARRARELRRLASIREIDDVQPPSSSSINESRNLSNINTHRANRRNNISYTNVDCPVFTLQEDAQPPXRIG

SEQ ID NO: 21124 - protein, 64 aa, Candida albicans
TTTTTTTTTIITTTTTTATTIAISDSICLEKKGRTYNKITMTKLVNIIIIYLDTQPVSYIYIYI

SEQ ID NO: 21125 - protein, 97 aa, Candida albicans
TQQVSTHTLMFSLKPRMATLLKYQNNVPATAKQPTKTTKLLYSLGVPSLIIEAAIGIPNKFAKDNTALRIPYLVPISLTGVIWDKHAGNKPSIEPEQ

SEQ ID NO: 21126 - protein, 100 aa, Candida albicans
FTLTHSHTLLLIDLIYFNSRTFYTPFFMFFLLYFTLLSKKRIKYSFFLCLSYYQDIIFDFTIDVRIPDFHGDNNYNNQKKKIDQFDWWRMILVLLLASKF

SEQ ID NO: 21127 - protein, 61 aa, Candida albicans
RIDAERPDPSEEKRKETKQKKKSKYPNSNQTSSTNITSLYPNILGSLSFNSTSNDYGNIYL

SEQ ID NO: 21128 - protein, 82 aa, Candida albicans
  UNSURE (63): Identity of amino acid sequences at the above locations are unknown.
LWFACSKQDFGKFSVACRTLNNRKALQLYKLVEQRSPVKETLGIINYKYIPVFTNKRVLEKKXKQRELKTLKLTKPILRMKN

SEQ ID NO: 21129 - protein, 171 aa, Candida albicans
FIKIVLILIPVSLDIIINRQSLASEAFTFMVPNGDPGGWNPLPDKTKLSKFNSFSLIKFVKVGIFSIKTWSTSCMCFDNEQFANIISNISLCKCFVKAGPTAMDNLLIQSNIAGSVSFLLAVYLKPDAKDAMLVVLMFGDSFDAALAKISCTPALEVYDNPSLILSNIASK

SEQ ID NO: 21130 - protein, 72 aa, Candida albicans
SVIPSTYMFSIIKKVTWKIREAARYRYQLNQSFHFKKKIFNQNQIKVPVQVLYLMHLQFTPYIPPTNLHSLL

SEQ ID NO: 21131 - protein, 62 aa, Candida albicans
NKERGYYNQFIYFKNKFLLIKSGEEKIMREREYFSLIFLIVNNNTTSNNCCCCCCVFSRFCI

SEQ ID NO: 21132 - protein, 212 aa, Candida albicans
FPLILKIPMRNRETSVVLDYLKQYLQREKETGRIFIDGSTFQKVMQYAVGIPSLKTIEATKALVEEYGKQSTEYYAGLISAYSNLDQFERADNMAYEAHRKSKIPFGEIQIWALQLKNNMRWKLRSPDTITSQYNEIKINFITKMSFCSAFQLFYDQGGISLISDIIQSLHNHGKLKQELTIFRRSKILQLRDERIYTTRLDFWRRKFEWHE

SEQ ID NO: 21133 - protein, 259 aa, Candida albicans
SVGFSSPVVKNWNRIPEAYLDATTSISVAPSTLQESTLLKSNINRSNLSVNSIDSSGSLNETPLSESNPASRIPSFNNKFFKIDLGKYDELMKSGDKKDSPPLDPSVNKHNFVIDNELTFRIDDFISELDNSSTSSVTGGGAVGAGGGYDDFAGGDDDDDVPGLGIDVDDILNSDKFTNFLMSPKANNSKSNKRKLSMDGSMKKIYKFIPKYATVDRLIDLLLLDSKYFHRDVHLDLTEYRFGFFSRLQFIYDYQRIIR

SEQ ID NO: 21134 - protein, 117 aa, Candida albicans
  UNSURE (93),(105): Identity of amino acid sequences at the above locations are unknown.
TGSIFPEDCNTNHNNSMLLSIRWDEALLILLNYLNDYPVTITCFLVLLIIALGIAIDYIITPKEIANIFPIPGELPFIGHLHLILENPALIYXTWVKLYNQSIFXIPIGNKRVVVVK

SEQ ID NO: 21135 - protein, 62 aa, Candida albicans
  UNSURE (30),(32),(34),(35): Identity of amino acid sequences at the above locations are unknown.
FDSPFSPQMTTEIIQITTYIKEKMTTNSSXFXTXXHQLINHRYTLLMFFTILIIAVILVAVM

SEQ ID NO: 21136 - protein, 155 aa, Candida albicans
  UNSURE (1): Identity of amino acid sequences at the above locations are unknown.
XLRYASGLTKIEIDRSHHQSLKKSSQESKPPQQQQQQYYGYVPPDEIQDLDDQANQQHQSLKDRAHLLKERLQVTADDIPLKIKLNKLDSGSTASGNSSGLRHRKREKLDLDNNPNTYDYDIDELIAEENDLARKEQQQEFYKDQIIGKEREEMV

SEQ ID NO: 21137 - protein, 207 aa, Candida albicans
GILTKEKGGKRWQPVANGGNGGKVGKGGKNNKGSKWKVIRDEDEITAAMDLGKWKSKLGGMKGGMNKGGGKGGMGNGGMGKGGKGGMNKGGKGKPQYEEECLEEEYSTEEEECDEFNNGKGNAGNGGKGGKGGKGGKGGKGSWKVKRGENHSDGNKHDGHHKGNKEDNHRDSDYECGYSSSDDEHEKPKVIAEQDLHLGSSTIRDDR

SEQ ID NO: 21138 - protein, 162 aa, Candida albicans
VSEVSGLIVVDVKVGTFVVNDSLIDTSEVVPVVALLVETDISGVTVPVISPLLSDEALKVNDLELSSPTIDVSVIVVSVVSKTVVVNTNDGDPATIDSVTMDLVEIVSAVVDTNDEDPVIIDSLLVDTDDGDPMTVDPVAVELVGITLVVSPSLRNFDNGTL

SEQ ID NO: 21139 - protein, 70 aa, Candida albicans
LIRVPESRKRNKTTQKKHKIWNDIHNVESYELGEHQVVFNTAYGRIHLYNVLKKVRALSLVKLSSNIAVY

SEQ ID NO: 21140 - protein, 159 aa, Candida albicans
YVLIIDLYTTSASSSMTNSLHISSIQEGQTRFVDSLVPRIDEEYVNLNSFKQFDELLTHLESSLSQLENNNSRLLVIPSSNIFRILFTLLSRSPNCNWTISNSLGDSIPTTHKQVKANNGYYEESTGKPTLCDRSRDVLEKYINLLPDDNLHHGRGRSA

SEQ ID NO: 21141 - protein, 111 aa, Candida albicans
LYNLNRSIKFRNNYLHIRKNWQLFVSTAADSSASETYKLTFPDLKKIKTSLNLDSDPSTKAPLNDTFLIDMLGCCSHDSNGNLLNFDFEKQGACVNIKDFAEILGQIGELD

SEQ ID NO: 21142 - protein, 96 aa, Candida albicans
TVDQEMHSVISYFMSRQFNNEPFSTVNDLTNSDNCESHIFLLVSYEHIGSLKESVSSNYTPPQSEIITVNHTVGKNPMENGTTALCLTILKQIIAH

SEQ ID NO: 21143 - protein, 78 aa, Candida albicans
  UNSURE (62): Identity of amino acid sequences at the above locations are unknown.
VNIYSNKMLSRVSIRSLPLCTRTFATTSILRQSELTAATDSSGKEIVSGAPRELVTERVVRXYPGLFTSDLKGSAQYY

SEQ ID NO: 21144 - protein, 63 aa, Candida albicans
VDRTNLRSQHTCIKSQKGETTIPKSTDTNKESNKQREFEIRIPFKTSSEQEMLQSYTTGPWKD

SEQ ID NO: 21145 - protein, 108 aa, Candida albicans
LPSFGTLITEKVVTMEMRELLHLTKMSHQSINLFIVAGLCNVNKPHMALQYLNTLSHIFPTISRKNLIKNQNFIRILHATQDVELAKEVMNYYRDIHNDYINVQVLQA

SEQ ID NO: 21146 - protein, 73 aa, Candida albicans
NWRMTVRLLVGATLESEIRLRSRLDTCSSDSSGYKNKVSDVVAENQVKKNVVYKTKVNNVFLNFKKRLGYCGG

SEQ ID NO: 21147 - protein, 72 aa, Candida albicans
  UNSURE (66): Identity of amino acid sequences at the above locations are unknown.
RVRISTEQFVKYHSSEYAIYVYDRITIINNKCKLTIIRERKESRAYIKLLIACITYWLAYSLIKCXIIKMNN

SEQ ID NO: 21148 - protein, 70 aa, Candida albicans
IVSHLFQRICQPHHLPNLGYKNNQPILGGSGGLLEGWIAKPSPDQRCNQFHYQQRGPQPDSFRVWQRHSM

SEQ ID NO: 21149 - protein, 68 aa, Candida albicans
SPIDEVNDDHIINIQPNNNPLFFNPYGMASIPAPIMVFNKLIDPDFIVARPITPIVCFINLSLFFFFQ

SEQ ID NO: 21150 - protein, 61 aa, Candida albicans
  UNSURE (6): Identity of amino acid sequences at the above locations are unknown.
LLIGTXGEVGGRQWNKKIVMWGVRLGRVTGPKRLAVITKRILFESNNNNQRVNKSIQFNLI

SEQ ID NO: 21151 - protein, 63 aa, Candida albicans
HNCQFVGIKNPTIQPYHLHCPIFKCLLGMNPMSKPCNPATEFHQLIDRTGPTMWTLPCLHIQT

SEQ ID NO: 21152 - protein, 77 aa, Candida albicans
RPHCWTSSIYKLMEFGSRVTWFAHWVHTQQTFKYWTMEVIGLDSWIFNSYKLTVMLLEVEHNIILVNVTCKLFKIIY

SEQ ID NO: 21153 - protein, 67 aa, Candida albicans
SNILISSFTPFLQILEPIQQLKGNEIPIFAVNHQLILIYSLPFSSSFCSYCISHLNEVIGGAFCERS

SEQ ID NO: 21154 - protein, 85 aa, Candida albicans
RLGESEKKKKFCRQKFRAMENRFFFFRLLTKRLKLFYNPDSVTTSKLNNSFIIWRNKLSSIAIPTTLLMGKECFERFKGFDEILV

SEQ ID NO: 21155 - protein, 162 aa, Candida albicans
KQYEDEAAVHRMITYKLPSILFVHCNHPKIDPLKNSKEADAEFGVYSRRNMGLPDKVEKLLEGKDWELRFHTISQWVACEAISKSSLYWEKIAGKSQQQVCESVGKYIEFLKKDTFDNEATKLTILNQLGEKLQPKQPEINNNNNNNNNDDDNGKNKQGAAS

SEQ ID NO: 21156 - protein, 144 aa, Candida albicans
  UNSURE (134): Identity of amino acid sequences at the above locations are unknown.
EIRESRGRTKKLRASKKGKKAEDQENKERGARAKEKEIRGNTSKQEAAKEGQTQKEKKIIEKGAKEKAKAEEAGETETPKIEAAENKHQEREKEKQEKEADPTIIKKEGFTAKTKINKEHEGEEGYDGIIVFTXPEWTGNAGIG

SEQ ID NO: 21157 - protein, 253 aa, Candida albicans
NLGGLAVRGEDLMYQRFIEENYSSLLQSFINDPNDLIFDPIDDLLAVRITDKQVNIYCPRCQKPLTFQLVPLTTTLETGFADPGFEAYSIEDIDEQIRNNPHFQVECICLLTPVWNHDQLRKLQLYHDVHGDTELSHAYKYFSSIISRVISIRRSPYLASSSVKSYVKNRWNNLQLNLYKEMLLVNLIKLVSSLPDEEKRLKNLLLRSYLQFNLIYFTVRGGIEIGEDLGCRVVQFHLFESFIYSYTFPESHN

SEQ ID NO: 21158 - protein, 241 aa, Candida albicans
RLYKSSQDSHFPFFCFDLTFFFVFTSFISCSVVTLLPTLHLKVISSLLLLLPNMSTTFRYSAASDFHQPLGSNKNNVFERNNSTVSSTNSLMSNNSDTNTAATAATSGSTTNNVKRMHSSLISKYNSNRSTIFTNDTDSISSSMSYDNNSTLASSVSPNSPANHHSGKHQHQLPSYMMNKSPQYIHQSTSRHSNLNHTNNLLHNTHSNHSQHSQHQHILNEDLVTLNSSITYSRDEDQTLR

SEQ ID NO: 21159 - protein, 146 aa, Candida albicans
ENDSELFFFSSTSDKFFFFFFSFSFNASYHQPDMIFPILPVISSPEDKQSIDEFSLVGQVLFPIESVSPKKHFIHQFPHDLDIFVNAIDNATTDQIVELLNVGIKQVSVNEKQYHDAIEAGLPSSRFVVTVDVPSTELWTSEASFV

SEQ ID NO: 21160 - protein, 70 aa, Candida albicans
TKPKRREKKLFVDKKKDIKKKGIESILKLSESKSLNNSIECHFLGLIQQLLLKEPIKKMMLTTLKILMMG

SEQ ID NO: 21161 - protein, 65 aa, Candida albicans
NINYRMLSNTFKCFIYSSTLYLMVIFEQANLVIPLIVSIYLKNKPKHCSNSLTSLTNQRIYQANQ

SEQ ID NO: 21162 - protein, 62 aa, Candida albicans
FTLRQKVVSKLVKKKKLSYQRVNVIQLSIDWSNFSNQVLPYIAYQCALVFTHAAGRSHARAH

SEQ ID NO: 21163 - protein, 141 aa, Candida albicans
YCKQEMVVVFIFFFHTYIHYFFGDLFSSLLSCQVMEVQQQIDELTTIYHEYRSFFPKCDLIVTPDALSSSNYILLTTHEGRSIKVSVALRGWYELTTTTQSQNVEKPFETFEALMQSISIDFQNRFGNELSNKLNQLLQQK

SEQ ID NO: 21164 - protein, 85 aa, Candida albicans
YSINSGDHGSASALKKICTQFASKIITTNTHTFKCSTIISIHQQDPFIVIFTKMNLEDKNRIEYKKEKKQQILNCFVYCFCVSHG

SEQ ID NO: 21165 - protein, 291 aa, Candida albicans
KKSIERFIGKLIFFYDVYVAAVFCLLLGCTIVSGIYFNNDSLFPISIFILYLCSIIISVVSFMCTRYFRLRGGFTNNYQVEEYDLLSLTTHQKQGWGKLIYINRKYNGGISGDYVISLMENYANAKLSGMTCKVLRVFKKHEITPNPSTSLLKKSKQQHKKNMNTAFEDLDPESLLFQESPGSQSYESPIKHLEDEYRPLSKNQLKRLAKKNQKDKKLLELKSLENNTEIFYQELMNTEALILLTIVEEFDLSERIPGWIGKKLNKWFGKNSKFPILCIRFGLLGFHWPFK

SEQ ID NO: 21166 - protein, 81 aa, Candida albicans
FADFPWPVVKIFASINFINILIAISLVQINISYFNVTSGSVKKIHNWFIITGSFMTGQSAIGLSIVLLINEKNRLKDSLGN

SEQ ID NO: 21167 - protein, 110 aa, Candida albicans
KKHTKQKEAKKKRKEEEQASKQQKEKRKEKDRDKSQEDLRNLEITKQKSKTKKADSQAFSKSQNQTEQKAKRRKSERRQKKNLSAANLRQRQAKKKSNQKINQKRLNHNR

SEQ ID NO: 21168 - protein, 61 aa, Candida albicans
YTKNITFEIFLYCFSCVNIFFFSKLFSESQVNGSHGITSQSIREKGRKKDLYPYYNFPEIY

SEQ ID NO: 21169 - protein, 334 aa, Candida albicans
  UNSURE (299): Identity of amino acid sequences at the above locations are unknown.
YHLQMIAQCYTLFNDDSIITQLANFNLSVSEKDFDFSGLCNSIHNNVVDLNDYSNKLIRSFTKHAKNTTRPFNSLDTALNTLFETKNFTLVRITRSTTDDVHGSSILKLETATPGDFNLIDDEENGDEMLHSLGKESEVPNNLFFKKIIARPRYKSNMKIYFIPEVANYSLYTDERMLERDLYNGIIQLEFENNDLNDLNVKRSNGYSRNVFCSFCYDQVLRDYKRSLFESDVAEVSPSNVQFIAPLANPPLQLQPGAVLVPPALPAANALFSTAPKLQQSPFTQRAQSIDDTMMVSYXEQQYPPYRPSIPLNRKPSFTMARPTPAFIPQPQSL

SEQ ID NO: 21170 - protein, 146 aa, Candida albicans
TQVMTGLSNLLNSEDLLNAPLKTIEQSSDQDSTKGTITPTRTLSSQSSPQLPLMSESEKSILSKNSYRPLVRLRHRLPKSKVNKKILASKRFVKLSIRRKYSTKKTKTDTKQSKLHIKSLKAGIKVKMTLSKNLFSLLPLLDTIYR

SEQ ID NO: 21171 - protein, 118 aa, Candida albicans
FTMPLAHNLNKVTKNISKSTGSLHIKGRKFKQLNRATLRDKKLQQRKSQSLERKSNELSIVFFIQSLLQEKNTANDGGDEDAEEGENFKEFSNKKQFTLDEMRPIIEKFIHLQPRRWK

SEQ ID NO: 21172 - protein, 62 aa, Candida albicans
DEVEKLDRERQRERSGRVLMVVVVVVQKNRNNIGKKGNDDDTPCHKYTIIQQYNQRKYCQTY

SEQ ID NO: 21173 - protein, 66 aa, Candida albicans
  UNSURE (54): Identity of amino acid sequences at the above locations are unknown.
KANSLEIDKPRLYRRSEFNINFYYLLYYTTFFLIIQVLFRIAIIVEVSIIEMHXLNRRDRRTEGCG

SEQ ID NO: 21174 - protein, 65 aa, Candida albicans
KQISLSTKQTLSINNTHSHSHKHTHATHSQPIHSTNPPLSQSLKSNYQVTQAVHSFEIWPDFPQL

SEQ ID NO: 21175 - protein, 302 aa, Candida albicans
CGGGILKGKLNLGNFGDLRSVIEKYNYFQFQVMLIFYQLLQEGHFYAKDEFAIVGKKSNASSHLAHGHAKLFSAIQDSYKKVGKYESEKRMKVLRNRIAIHGAGNRMTLGGIDEVAKFMSKHFTPLLEDANLGIQTIIEWLEAANEFRIYAWLPGKWSMHVLKQKEINGKVFKARTTLKDLLCKFEDVETMKKMMVDSTRSENEMLFLISQGVLFLQIAKHQCENILKILDLCLDLDERRPEPKFITFFTKNRYSKPRHLSSDMDKPMPDYLSSDIQERDADNLPPANAMHLSAHQAEEINV

SEQ ID NO: 21176 - protein, 71 aa, Candida albicans
FERYWRFVFNYTLYSSVKRILKFRVMLKYKGQKLQQSTSIARLQEWFSGKIQRCHRWAPGSIPGSCIFCLS

SEQ ID NO: 21177 - protein, 60 aa, Candida albicans
KKKLLDEYKERNNDNNKKILFCLYYFFLQRVNFISIFISQKKGSVELLKSVFVQGRQHRL

SEQ ID NO: 21178 - protein, 70 aa, Candida albicans
QYIYGSHKNGQLYPEESYTNEQTQLLRIVDCVLHGLCSNCQKILKLFFTTDVADLVQKLILAILHYLFFD

SEQ ID NO: 21179 - protein, 97 aa, Candida albicans
THTQHLRMPPKSLKLIKKGLNPPVQDNKTFNSLFKEALNSPEHFLCNNLSNFKLPSDIDFFIGFIETKQFETWLDIISRQNNWTRNKSPPRAGRSAI

SEQ ID NO: 21180 - protein, 272 aa, Candida albicans
KICPQATIHLIRIPVLVEERSAVTSADGPEYPHHQHQQSINASTVPVPLPPPTPPVSMPQHVSRSPRSHQLHQPPTLPPLHSHHVQQPSRDRSPLATRIYPYSNSVGGQISTTSVGSIPSQIPLGRQTHGKQPSISSVISGDSIAAVGLGEQENVLPPSTGQTGKTATSEVNRNEEGYGFGGHYHHDQPETITESPELRGLQQPQSSEAEISKDISNDVALDSAKIPEASQEPEEETDESGNVAAAPPPPPVAPVAPPRKTKSSRSNPYAPS

SEQ ID NO: 21181 - protein, 95 aa, Candida albicans
NLISSSEDCNDRNSRYFNTNNNNDIPVNNPSKILDDFGNLCPLKILIIYNVSTLFPKNKNKKEICELIEKLVDLVDLVCFIEIELVSSVIVVVIV

SEQ ID NO: 21182 - protein, 77 aa, Candida albicans
  UNSURE (59): Identity of amino acid sequences at the above locations are unknown.
TEQVKWYGLSLLELNNTSNPAASEYILEKLKDVDFVIISKHVAGLTSLKYSLKSGLFSXSNTRISCPTAATDICRPG

SEQ ID NO: 21183 - protein, 245 aa, Candida albicans
ENNPDFKEYFNDVRPATCLEMMTKSTSFNFSRMYSDAAGFEVLFNSKRDRPYHLTCSVQLLKVFFASRVELPTGQVDNNTDEILNVPNFALTYKTNILNQVVRARGFKNCVVEIYFSASTPILDLDTRQLSSLLYNLVLLKKWKTIKKLEKLLEKTPTSSSDLQDDDFDGSETSNLKIHPGTPHHKEKINARIWRYLTDYYPHLDIKTVVEQPRLVLRHCEPKKNTQILTFSYSLSSPRDWQDRR

SEQ ID NO: 21184 - protein, 75 aa, Candida albicans
  UNSURE (12),(13),(26),(29): Identity of amino acid sequences at the above locations are unknown.
YLVLPFVGLIKXXESNFYKVASVKLXTNXRLHSILSFSFVFILFLQYIFFFFTISFNTSIITPHITSFLVLAQLD

SEQ ID NO: 21185 - protein, 63 aa, Candida albicans
  UNSURE (43): Identity of amino acid sequences at the above locations are unknown.
GQKFKEEPREPKEAKKGTKKLGQDGKKTKDSKKTNKIIKLKRXPNSATQLVEKFVLIQPMTHL

SEQ ID NO: 21186 - protein, 116 aa, Candida albicans
LINFQYSQSLSFHLYSYYFVLPNLVQLSKMSPIAILDNYGNIQNELATIIPIPKKITMLSDEIIGKILDYVNQIDIINLSSTNKSFSRIFQRKLMENIYVCDTPNNNFDHSLKNRI

SEQ ID NO: 21187 - protein, 79 aa, Candida albicans
NHTTNPNIAIQLKNMSRTNNKNPIDQNWQNNDYEIKEQDRFLPIANGMYKLYPRFYHYYMFCFVLFYFILLTYLVLLYM

SEQ ID NO: 21188 - protein, 61 aa, Candida albicans
ILQEILNFITEKFLDFNYCNISSRYCLFSLKINNSRLEISSTQAVEHRTVFVIQEFCWCFV

SEQ ID NO: 21189 - protein, 100 aa, Candida albicans
  UNSURE (73): Identity of amino acid sequences at the above locations are unknown.
LIKARMFNNCTSILLRRIVILGTISTLVDDPREELLKDNADIVECGDEDSEDELDDLDVPDDVCPADENDEKXIVVVPVADLCQLNFLKSLGVKLYRFIN

SEQ ID NO: 21190 - protein, 84 aa, Candida albicans
YLSCGPSPRLCVKTSLQVFEKDVINDGNQKSSLSFPNVRSAGTNTDLKLVDYRTILEENDLSEIDDDEIESVQNQKELEKFLQD

SEQ ID NO: 21191 - protein, 61 aa, Candida albicans
INARCSLFTGQVRNMWAYPNNDISSHHHQQENDFVLIPSPTQYESSSSQHTHTPRNLPRQY

SEQ ID NO: 21192 - protein, 178 aa, Candida albicans
VNWENLSSMNIGGLHHQSSFSSTKSVIRNKLALGNRPSLLKYDSHTSGNTRNKKQRQKRNEVGNNSDDNDDDEYYQLLRKQSGYITDSENEGYELNSINNEDEEEEEDEEEEEEGYDQDDQDDDDEEQFYQFRRGQRTVPEITINQKLNQQQQDERRSSNADSIKHLSPTSSIKRYFN

SEQ ID NO: 21193 - protein, 61 aa, Candida albicans
LVRFTRDSFFNFILTEKKRREKKKFIKKNKTKQTQKKKIEIKHTTHLSLQSIFTRRWKEPN

SEQ ID NO: 21194 - protein, 266 aa, Candida albicans
IMILRSTASGKRLPKIYYQLYFLSTKPQSNTESFAKYGILPYFQSKLNLWLNPGSQVKTPPTEIQTFILQNLLLNKKNVIVNQSNKPGKSLGLLLHALNLSLTKRPWYLVESCRIPQKPARSLDSVILVPTDEMVSKYHKYCEKLISPMERNCVPVEVFKTNGSLHITRDPLTVKFLSRKKLPEITTDSLDSKLDTANHSQVTVTTLSGLLDTIQNDPDQFKFLRFFAIDQLDYFMKSVDLNGFLVVSQHVFTTGLEAPRLRITAR

SEQ ID NO: 21195 - protein, 75 aa, Candida albicans
LSELFSVDRTRYFVCVFERIWLYTHLIYFIPREKNNPNKQQVESLSSNISENEVEIDDKKFRKVEGDFKFDIACA

SEQ ID NO: 21196 - protein, 76 aa, Candida albicans
RIQKYMGLNIHYSAVSLIVLFQESIKKYFIKLSYLEPTKLQLRNDRIVINISNTRFNIILPIDISGFNTNRNSFFL

SEQ ID NO: 21197 - protein, 69 aa, Candida albicans
FHSCLHFLPNPPANMPPQQLPPTDIQSIRNAAHALNSTLLSRTYIDENLQFNCINWKTLISDQLEVTPN

SEQ ID NO: 21198 - protein, 66 aa, Candida albicans
PSLTLYYYTKKKNKRHVIRDEHNTPSLFLLFITRNNNNNNIIDYKKNDMASFGVVVLLIIVCIINT

SEQ ID NO: 21199 - protein, 113 aa, Candida albicans
ILFFCTIYLHSLFVKCIKMCSEFFFFNIYKNKLLLSLDISNYDMSSLDYLWTEDYLNSFEIENRFTDTTITFIIVSKDPSTCYDNLIRFSQPWLKSIPWTIDQPSITPQSTHY

SEQ ID NO: 21200 - protein, 83 aa, Candida albicans
  UNSURE (61): Identity of amino acid sequences at the above locations are unknown.
RPKIDYFLGNLIIHEYSPEIITFKFQFYFQSHQLSSKNGVFPLIESNKPMKQTQFYGSGFXNLHEFPENVLPPNNPKLGFLEF

SEQ ID NO: 21201 - protein, 81 aa, Candida albicans
KGRDVKNKQSSFKNMTELMCVYVWVTTMVTIVVSQLSFIHASLGNDDNCKNVAPKKKKEEETILEKHVDAHSHSETKRMTQ

SEQ ID NO: 21202 - protein, 69 aa, Candida albicans
PKKKRAKLSSDIRDFIDYLYRQLNYETSGKKAKWKGEGGGGEIDREIPYMKIIILVVSELKMSSEWWWW

SEQ ID NO: 21203 - protein, 63 aa, Candida albicans
  UNSURE (31),(35),(37),(38),(40): Identity of amino acid sequences at the above locations are unknown.
EKGAVMQHESIEKRRGKEVQEGTKKGEEKRXNKKXIXXSXTPTTTPTTTTTTQKTSLTPRQLV

SEQ ID NO: 21204 - protein, 126 aa, Candida albicans
  UNSURE (8),(12),(14),(16): Identity of amino acid sequences at the above locations are unknown.
SWDAKYTXTEPXTXTXTEPLACLFLSRPPPYPISQQFSENVYCLYCRINNKKKHPTKMEICLNIHTNSYCENQEYIEITPSLCMKTKPLYSTKQNKTLYSWLGERESKYASSTWSNNYNLKYYKYL

SEQ ID NO: 21205 - protein, 96 aa, Candida albicans
  UNSURE (92),(94): Identity of amino acid sequences at the above locations are unknown.
NIINTCKNVHIINTLNGSILKNKNYIFQESKTLGYTIIMTIEEYRPESDEKNVSTPSIVSLDDKTTNASHISNAAQENVDDYIAKFLGTSQXSXND

SEQ ID NO: 21206 - protein, 87 aa, Candida albicans
IYITKRNKKITIIIIDNRKLIQKYKCKKSTFLVAYKKTKSKIQNIIVQLFYKEKNKNKKEAGKKHIKSFQSITFHSGLFLTLLLFNF

SEQ ID NO: 21207 - protein, 108 aa, Candida albicans
TIIGMAMPHGEDWLGENKIKVKPLNDNKAIEQGATFISEFFIFSVAGSLIFYESYRSRKKATSERDALADDITLLQSEMEKIKNKLEDINVKLVDYKVSESPSETATK

SEQ ID NO: 21208 - protein, 258 aa, Candida albicans
RITWIRHVRGEDVMSVILYLCDQSEATTTTTNSDVDVFKFYFPGMINLASIYYYNFKNTYKSFVSMCQFYNLRLPSMMITYLNCPNVELQSILKSSLNSYMIYKFEKILKFKLNRISVHFKIHNINSFDYLPQLILSLGLNLFNFEISQRIIDLILFDPNYDEIIINLIINYMMKIQHKLFGNKQEILSALLGGGGINSSNGTTTTTTTTNANSSPSSSGNGSSSTVNPKYITGLNTYRYVNVGYEIEFLNSLRELCK

SEQ ID NO: 21209 - protein, 124 aa, Candida albicans
HSTKMIYLYDILDKCPHLSHLYLNDMDIDQQAMVQINKDLERISCHLQMLDLSFNKIDGVSLIRMFEKCLIVNPIEQMVLHGMDISTDTIQYLIRKKYVNSVSMDTARLKWQAFGVNSWVQERS

SEQ ID NO: 21210 - protein, 256 aa, Candida albicans
NCNFVWRCDIYSEKKKLKKLLLGCPNTHLFPPTLKRQMVLTRSQTHYKQPIKKKFTDDDFSDEEKVSPLLPVQPEDDYLSEEEEEDDDDDDDSDDAPEEESTSKARSDILSEQKRLQQVEAELKKQEREKRKALDLRNTQQQQMKKSKQKSNPSTAPIELPEFLPDDIASIINQPVEELKPRHIRLDEIEASPKLDKKSLLEEKLRLLKAKKKVAIKKGPVHVKIQSFNSKVVPRSESKIVKNRDKWLHRKSVNRK

SEQ ID NO: 21211 - protein, 79 aa, Candida albicans
LGSSAAVKKKHMSIETNDTFDNLQTDFKLRSRSDTTNTTFNNNLNDSIDSGSTIFSARSQNTILNKDNSSSTNGGGPNA

SEQ ID NO: 21212 - protein, 306 aa, Candida albicans
NVAPNPISASSSTGHSFSEADIFERTCSKHNYHYPLINNPETPSHYNLENYTSPILDTATEILSNNIPLDQVKLNCYCDENENENEIDKQIENENEQEENTDQIRDQKQEKEDILQPPSTTTTFIRPRARSIISQTLISTLDHNRKMHSSMSSTGFNNNHNHNHNNNHNHNNATATATAISNYNPLPPPLLAKRLMSYAGQTPYSQSKGIGKVDKEDNDPNTIDFFSFADIINHEEVEEEQEKGFINTSPTRSSTSSSSNSGGGRQFNQMVSPSPSLTQPPVNDFHPIRRGSCVATISAKDYIGRF

SEQ ID NO: 21213 - protein, 293 aa, Candida albicans
ITIKLKMTQVIEDTYPYLPVYEAVAKESDNDECQPYFDFITTLKEAKQTDYQRYKYRIDTDFPKIDKLVLRRPTCMPNIPEAVAHLKLLKAFGVLKENVLGCGNDPEKYQIKKWKVFITCAVRRFIIFVSALRDCYSDGSSSRELPFYELQKDASFNETMDLFLPPLDVVMVWHAFLLNPKTFYDLFTREEFIVYAKYPFPLDILESCIDNESFEYHVSDEYKTNYTNLLKTFTDQSNDLKYDVGTFSMHEELVVVYCPQCEVSLSEPIPMTTDRETGFADCQFRAKPLINNI

SEQ ID NO: 21214 - protein, 158 aa, Candida albicans
SHSVLEKVNSTLEELHNYDGNWRANSIDNNENSEPTETDPVSVAKKFTENIDLKRQEVLDNSTPIKPLSREGIAQSQIKSGLLQSTWWSSAKWSKLRKIVKLKLISREEAINSTLLMSELECTNKMELRKRYDFLEKYINRNPNRTTTRGKGRVTKTR

SEQ ID NO: 21215 - protein, 357 aa, Candida albicans
PTAYLFTCLKMYRKHIRKQSLVCQIQSFPFDLYLYLHELHASIDWDQYNYIIALPLGIISITIFSIIQSILNYYHYINKRSQNILFDSNYIQYENLKNNIIYNSSKQPQERTTSSIGDKEIVDVPFTTTVLWVLKSINWLIIFIGLFNAAKLFTKRKSYGLLYCKLKPKSKNVFKSSIERLSFIIEILAFLLKFFQNEQELEEEQELNSFNESSIIMDSTNELIDDNEIWHLNVWDPSKFSLYLFIGLNPINLYIIYYLIGENNSNTSFTDDSNYNFIYPSYFYLNILILICLIMIIFYKFIEFFLQLINDKQILYQEMFQEYNKKFVNPKINQLKKDAMIDATLGTHYLNNLNDQK

SEQ ID NO: 21216 - protein, 94 aa, Candida albicans
VRRGSAPRGQDIPVLPFSRHYMDFIGEYLPALEGMSDSNSNLGCGSESGCGLGLKLPKFKVFDVQYKVTLPIVSVLKDITSIPKNTGNLYYKPK

SEQ ID NO: 21217 - protein, 60 aa, Candida albicans
LFHQIWLMVQEVSHQLLVLMKLLFSKLNYLVLMVNNYVCDQTRPTIDKYMCNYFIFLENV

SEQ ID NO: 21218 - protein, 79 aa, Candida albicans
LPIQLLVVVSSDNIHNYHVEVINCKLSYTLSISAKFYLVFVEKCSEKKKTTRQLELFFSSTTNCYYIVIHFRGLISNYM

SEQ ID NO: 21219 - protein, 112 aa, Candida albicans
VAGRCTHPPCLIFFVSFHVATASVHEKYKIAGNHENFTDPFSNGKQSSTIIKYQPMTIKVAFLGPEGTYTHQVCSHTIPYTDFIFLFLLGYLLTIILKALIFTSRMKEYPWK

SEQ ID NO: 21220 - protein, 92 aa, Candida albicans
IIQSMVKIIHFHMIILTKLIAVSNAARPLIVVVMSIYIYIYTVVLRHLGMKGEGGRGVPHSNKQDFVFDDLLAPLATHTFHHGTDGSRASRN

SEQ ID NO: 21221 - protein, 67 aa, Candida albicans
  UNSURE (25),(36): Identity of amino acid sequences at the above locations are unknown.
HMSHVDLPLSSSSSIKQRSESERSXNATLNSIDIAXHSVDRNRTGQQHHENDNTLLSTTSSPHSKLG

SEQ ID NO: 21222 - protein, 63 aa, Candida albicans
IRHSAETKLETTRRYHNILKLMALMGLLIHFQKDLNSNKQLLDYLGFVLYYLWCLKWLYLIVY

SEQ ID NO: 21223 - protein, 93 aa, Candida albicans
FTRWSVNLPKGDIASDIHESTMHMCFRVMYLEELVILGIGVIVVTWFIVSIVRKYCVSENWFSYIKSRSLITLVIGHIKTYLKYTRGLLNDYR

SEQ ID NO: 21224 - protein, 60 aa, Candida albicans
ILMRGSVDLRGEDSLLKTKVILYNLYNQTVKNESRKAKQKVKVVVVQFPIMFLDTFFITK

SEQ ID NO: 21225 - protein, 85 aa, Candida albicans
  UNSURE (39): Identity of amino acid sequences at the above locations are unknown.
GGRKNLRRRRKGEEDGRRRWIEMRRMNEEKVGGCVWMGXTPPPATTTTTTTTITAHYHHHHHYHLLSIFCSTKTFFFQVFFYRRR

SEQ ID NO: 21226 - protein, 230 aa, Candida albicans
FKNWTITSFNENKSDSQQQHQEEEEEEEDKKELPLLQGNKNLHNSEYGIILANLSNLHEFINIHMNYMDENNHKLKTKTIFINCLLNHIMIFLNHSGIVSLLKNLHYLKGSSIIITNNYLDSISWKLILKSLSDSTSKKCGKIYYNYLKTRQNDIEITPMMYSQLIMTCMNGDSNGYFHDVLFYIIEYFKQYSKLSSEIKGVLDYGGQYDINVKTLLDNIINWQNSNENM

SEQ ID NO: 21227 - protein, 89 aa, Candida albicans
  UNSURE (45),(62): Identity of amino acid sequences at the above locations are unknown.
YQLSSTYTQYFLMSQDSSDQRPPQSESLQTISSEHTTTTTKHSEXRISETKWENGNHVCRKXQRVHNPSSIKGKWVTKKLVATGLKVNT

SEQ ID NO: 21228 - protein, 74 aa, Candida albicans
KGKRRKKKERERNLYYNERKKERSIEKKKKYSIQRERDREKYYRQVYKELSNKLSLLILLLLLLLISILKLLIT

SEQ ID NO: 21229 - protein, 274 aa, Candida albicans
IITNNNSTCHYDMKFSTAALTFSLLAIVNSSVITYGTEFGDNYEHKHDKYDCEIDTFNWKFALVVKEWKYHKDEKFCKDTDLDLVYEGEDGQLYHGCDGTYPYSKCKHCTNVFAGGDDNKWKDDKWDDKCKDKKCHDKWDDKCKDKCDDKHKDDHCKDKKCDDKWDNKCHDKCKDDDKCHDKCNDKKCDDKQKHDHCKDDNKCHDKCKDKKCDDKCKDGDDKCHDDCKDDDKCDTHHCKYPYCEIHNTDCDLLITLCNGVLKDKKSSPGVEDQV

SEQ ID NO: 21230 - protein, 121 aa, Candida albicans
KLGKTKKSILVLTTTLSNSFKFITHNKHIKLHMETKIQRNNMCRDIYICVGLFMCCYIVECITIKHFIIIRAGRKRRRIKGILSKSVLLAAFATIQSVKKSRSEFRVDASFEFELTTCYII

SEQ ID NO: 21231 - protein, 74 aa, Candida albicans
ILKDELVARRIGDLQRAVPTFLTELGRLGIKIGKNFKKYCIDLNHDSVQSQTGLVSNIIYIAKKARSEDQCNLL

SEQ ID NO: 21232 - protein, 144 aa, Candida albicans
FILHRQDTPLYSAIKRACDVKVGIINSCSILNTFSKKRRGTENFDAMTYAQMAMKINIKLGGYNHKLSKKDSQGLFDKNNVPIFITWCLMLLHHNREKFILNQFLLLLLLVVKMEFSINSLDQFVFKLVDKKLLLMLKVWFWND

SEQ ID NO: 21233 - protein, 310 aa, Candida albicans
DDLITFSYSLSMIPTFNAAIDNAVSKLDMEGIIATVDFGIQSSDTSMGRINTVGGLVNRDIPWILRNFWRIWFEADKVFLDSSRRNYLEYKFGTVKSLNSYNKALGKIPYYIWIGCDKSKSHTILERLNCLATESPYLAPTTTPIANQLEDIPISKGHEAALINLQKNLPYPSMYYQKEYWRVYYDEMNPLYEQFKNQYIYAFTWEDPREDHKLLNFTSDDTVLAITSAGDNILSYASLPTPPKKIHAVDLNPCQNHLLELKLASFRCLSQEQIWSMFGEGKIENFNDLLIDTLAPHMSSNAFQHRMDNF

SEQ ID NO: 21234 - protein, 196 aa, Candida albicans
  UNSURE (181),(184),(185): Identity of amino acid sequences at the above locations are unknown.
VKERKKGCKSESGKKTYKSISSQYIISDQFPNYIHPPKTISLVCSYPEKTMSIDNQALTALKNSGQEVKNNTNQTSELSKEEKLRKRREQLELWRQKKQQQQQEQEEVQNKAKKTEDSTNNTSTEEVKKSRQQRIEEWKRARLQKQQATKEKTTTITIKKKVHLQTTRTTLKRNLEFGDDXDDXXNSHKPVFKKQV

SEQ ID NO: 21235 - protein, 82 aa, Candida albicans
LKKTAKKIMKGARFELARSTDQQITLVKKDLNLHLKSVTLDQLGQPSKFDVNSKVHKNQKGKTELRNEIEKCKETKASKYKR

SEQ ID NO: 21236 - protein, 71 aa, Candida albicans
RIINLYLKNNIRLKLKTDTYILYNLISDFCIIFSNPLRSDPVVHEPPHTTITTISSGCKCLKFLYNKSILL

SEQ ID NO: 21237 - protein, 64 aa, Candida albicans
  UNSURE (12): Identity of amino acid sequences at the above locations are unknown.
LNWKWNIPLILXIEFLINFTTLNFLNPFMGAPLNSTGGVKKFSINQFAGGAKFWKINKGGKIKG

SEQ ID NO: 21238 - protein, 66 aa, Candida albicans
SILLTFFCVYIYKDFLNRKYLQQHPFIRTTSKQEIYKRNNNLLKKTYTPHTKVLKRYRYRYISITF

SEQ ID NO: 21239 - protein, 96 aa, Candida albicans
IKQNPHLSMDYPSGSDPFTSRQHLLHHTFSPLISIEATHNVDLIFQSIINNNDNISTLQIFKPYGNNAKYSINTNNQQFKIINNQLITKNYPRVPH

SEQ ID NO: 21240 - protein, 70 aa, Candida albicans
PQTLWHNSTHAIAPPLQIWNSCRIPPYETEELATARPFESGPPSEERNLLDQYIGSADWRARKEYNPRKS

SEQ ID NO: 21241 - protein, 65 aa, Candida albicans
NFACATTPGRTIPRTKRQPETRTTTTLTTDALAQQHTRNSPPTTNLEFVQNSSLRDGGAGYSQAI

SEQ ID NO: 21242 - protein, 61 aa, Candida albicans
ALFQHVVKTWSGLIYRVIDDMIEKRSKIDKNYHEDLAAIELKFMDGKIDQTEYINTILGDF

SEQ ID NO: 21243 - protein, 62 aa, Candida albicans
WDQITYKSLTCNWYFLEVVDVWVNQSLVGYKNIDIKIPSIYINKRVIYRARCFQHAVEGSKL

SEQ ID NO: 21244 - protein, 80 aa, Candida albicans
FTLDFLACFCLAVVIIIEFRRSLETLFNSLRNQYIRIKSLIKRINYQLPILKVYNKTVYLYSQSCYIWKSIQLKFQDLAI

SEQ ID NO: 21245 - protein, 65 aa, Candida albicans
FWCFFFVPSLVRQITGAPEFGFERKFYIHKIGAKIMGSNYLQKSDLQLVLLGGGRCMGESKSSGL

SEQ ID NO: 21246 - protein, 171 aa, Candida albicans
MEMMMKLTDDLHTIDFDIEEFRNIPSLQMMLQELIPPAERVRILLEDPRYSDLNFEERAREIAKRKYSNIFKIIWWKIMGISKLDLYHWGVLKLIETHHHDHPEGTESTTENNQPQAQQQQQQQQDQQQDQDAADSASNSRNTHEARSSRDMEELGDVSEATRTETVMNRV

SEQ ID NO: 21247 - protein, 72 aa, Candida albicans
ELSMSNIQFNLCTTFPGLLQTYHESLYDLITTYDLYLSYKRRQMSLLFNLLFSSAELPSINKLDLPQGWKTA

SEQ ID NO: 21248 - protein, 139 aa, Candida albicans
FFNIFTHLHIYIRLAPYHMHLFLRIPPRFGLSSWGSIRPILLRRIPNFPRFNSSTGSSLTIRTLSPSLLQRAQTIQQEHKELSEKLDDKYIPDLQMKFDNYTNILYMFGKLETLTQEYIELTEITDDPDLSSPRVKIRV

SEQ ID NO: 21249 - protein, 239 aa, Candida albicans
IMKKSNSKQLLTTLDLPPIIPASITTLDFDHAVNSYQPGNYNPEDLPDKIPIINESTGSFRRFIRRAKSTRIKKNNDKRRIVSAPPGTYIGKELPDIPSNMPTTPITIIAPKDRTNRKPLYTNPPRTISLINENIPYPVLTTPNYNPHQIKLVVDEPHLKLEPKLTNDSETNSIGTDSILSTKSIDIPVAIHDDAKVTVTHNCNSSSSDNDSLVDSLFSKEEEQEGVFTTGWTTALHSA

SEQ ID NO: 21250 - protein, 61 aa, Candida albicans
DNFWLSIFKTLLLIAASNYIQTVIFGIVSNWRRCFPDEFYETIKNSARDCYRKGNFFCSKY

SEQ ID NO: 21251 - protein, 256 aa, Candida albicans
  UNSURE (250): Identity of amino acid sequences at the above locations are unknown.
ITFSRSTKTKVYVVTQLVPRIIFIEYIQPEKGSPLGRANVQYPISPERLTDVHKSSDNLADAIKLPVLPAINKVPPQEEQRQPQKYPQPQPQPQSQPHPYQQQQQQPRQQQLYSPQQVQQQKYHQQQQQQLQQQQQQYYQQQKFQQLQQPQRPLQQQQQQPPQQQHYQKQPQQQPQQQPHRVPPPQQQPQQQLSQAYRAAPPTQQKQPPPQQQLYGRSQPQSFPQGTTKWSSTRIRVYAKSWVIVPHDRXWKDQTL

SEQ ID NO: 21252 - protein, 87 aa, Candida albicans
  UNSURE (13): Identity of amino acid sequences at the above locations are unknown.
PKGEWRGPYPNNXDSGRVMSLSNVQGHCDDQEYQTGLQGKLGAFSQGVATSRGDGGMINGSSSESRSQGQQKPKYMSSPNWFPESYS

SEQ ID NO: 21253 - protein, 72 aa, Candida albicans
IIKIAIAIPIGTGNTIKKGWNPRAKSILDKSVPNIEVILPNGYLCLASAFNLNDLSKSALVNTALAGSTSNH

SEQ ID NO: 21254 - protein, 61 aa, Candida albicans
YIYVVCWKTFIKVAFEKNQIPKKSKFSRKLCKKICSKKKKPKKNMDLEKLTIFIQVVKKNL

SEQ ID NO: 21255 - protein, 118 aa, Candida albicans
IDLKQQPYIITGSHIITFKMMTFDNYNTTKDNSSSNNNTTDHGNNGHNSHFYRQCSQEGGNNQQSQRQPPPPSSQQDIHLQQQQQSLQYPFMQNLNTRVSHTLPFQQSIGNVNRAPSV

SEQ ID NO: 21256 - protein, 116 aa, Candida albicans
SLSADASTPVVKTPLGTTDAIVLAKNVKKVEKKSYSSWQSLSKVNNFQTMSEIEKEDSQQSSRTNDLLPQLPNKWRIFTKVSNFFQFQLVLKNQAAVARDHVRLNFPKRPIFIIFY

SEQ ID NO: 21257 - protein, 172 aa, Candida albicans
YTLNLAALCILTINSPTVLCDEFYYSDTIDLCHIHQCLHGFSVTNWVLFTISFMMILYCTFIPEIKRHGVKHTLSPSQFYISCIIIDDNPKSIEVIASESASLDEANIHDESEIGMAPTVYATNNTSSLDANNAIVDSNLESSEDEKSIQKIPIEAVYEKTDISKPYASKKK

SEQ ID NO: 21258 - protein, 60 aa, Candida albicans
FTKVIMEFYMILNYYLLVEYLIFSGIQTIILHITTYWNYYSSDLYTIMHLLWDYYVQLHL

SEQ ID NO: 21259 - protein, 66 aa, Candida albicans
QYNYEIFMKLSMFLCLAMLLILCTSRQINGNITNNLHMKKINKTLYKKLIYLDNIYYKLPSLISTQ

SEQ ID NO: 21260 - protein, 70 aa, Candida albicans
YRAWLSIVPKTLKSLLTVKRSTWQVTMFPANKMLILQGNEGLLDETHTTKYGVTKIYNFYAKLILLIMYD

SEQ ID NO: 21261 - protein, 61 aa, Candida albicans
SSRQRLVYKESTRVRKCFIKADLNFFWFWIKECKKVLKKVKYQKGKLIDIGKPGLIRIRVE

SEQ ID NO: 21262 - protein, 107 aa, Candida albicans
LKFNKITIMKFSSVVLSALLANLVASAPIKTVIVTAFTTVLVDSKGNTKMQTEAATATATLSGNAAAANTDVTQEYNTPSTTFTATSYSNNNNWASAPSSVHTSIVD

SEQ ID NO: 21263 - protein, 143 aa, Candida albicans
NSTSNSIIGNPVTKPLDYSMLIKCSSQFIRSSIRNRKLTQTRKIYPIHQQMSKRVFITDFFRNKSDSNKKIKVVNKVKNENLVSKAQTVVESGKEVSDPVEYDQRNEKVQETTISSTPNDRLLESGGYADFCKEHHFDKVAWI

SEQ ID NO: 21264 - protein, 87 aa, Candida albicans
FTLLVFVAITVAVAIVECPYRIEFICLYKEILLEVDYKGGSFLLHKTRPPKTRILSTSLSTLPRGGRLSELAFLQHPSHLFLQIIER

SEQ ID NO: 21265 - protein, 63 aa, Candida albicans
HLLLLLEFPPEEGVSFICLVNLVGSNSSIYVSIFLAPFALPLLSRPSPLFLSFFLLPKKFRLN

SEQ ID NO: 21266 - protein, 63 aa, Candida albicans
EISKNFNQQFLNSEKYIILPYFLFPFPFSFAIDIYFSIVIASYRLDFLLHFILELHTKSCQNH

SEQ ID NO: 21267 - protein, 101 aa, Candida albicans
LPLQAGILIIIINAKILFTISLLALFLSIKQPISVKFIVIFVELRERMEGGKKKGGLSEIRNNQPTNQPAVIILLLLVLITHFDTLSNYHFIPSLSILTLP

SEQ ID NO: 21268 - protein, 73 aa, Candida albicans
VSPMTNAVFTLLYNPDYLAGALVLGSVLKKLVLRSDQKYPDLKFGILIDKSKFTSYQLKLLSRYYDDLMDVSP

SEQ ID NO: 21269 - protein, 97 aa, Candida albicans
DGATVRHGCFGVRFIFIQEEANKGLATTEHRLETSLARKLLNLALPLPPLCSIFLFYSSLSFPPPLVASINYCFPLSYFGFCNFIFFFFFLSSFQLN

SEQ ID NO: 21270 - protein, 63 aa, Candida albicans
NSNELNNSNNSEKKNNHQEKEKVKENESKYVFEFSESALKNLLEGWILMANLIGNWKGRRKKK

SEQ ID NO: 21271 - protein, 82 aa, Candida albicans
ALFLPARAVNTLNELCVRGPNGSTVTRIDDLLLVSFRKVFITEQGIGSGDRETSQFLGNAKSEDLTGNGLLTSTLAVLSSIS

SEQ ID NO: 21272 - protein, 93 aa, Candida albicans
SMSTSEFLRSSPTRDDNDNDYDLKKPIISTQTPLHNKISSIPLTKSSTSTSLKNQQQQQQQFTMGTPSITASASKYINQSLNLSGWTPLISKT

SEQ ID NO: 21273 - protein, 340 aa, Candida albicans
DVELAIGVLEVLVDISTSLESQIKDSINNKLNKAVVNSMCQDLLRIKDKIIRWINYIETFPINDLQVASRFKWCQIIKEKAETKSWTENHPVKHKLQKLLGDAHFKINYPNYKNFIDFSKDSINSQLTIISVLAIFWRILSTSSTEDNKEAIRLLEDILLDLNTEPSDAILSIRNFLKQGSIDMKLSLWNILLLFYQLSNSGDKLTVGFEECVLFLNDYLVNEYVLLDEESRLVTLLRILGFYGSSILFVVTLLASTNWILMHPIKVQTLRLFFELSLLFEINEEASYISSLATSIKSKSTKSYHHLTNTLIKTIILILASIQKSNPQPPLFTTRTRTGL

SEQ ID NO: 21274 - protein, 95 aa, Candida albicans
QKTVINIGYNLQGLKDVIVFFFIKYQQQRKREQKLEYVLSSFCTITPSFLFVSISVHNYVIVKLVPEFTCFSVEKNKPKKMVVVAAVKIQERERI

SEQ ID NO: 21275 - protein, 67 aa, Candida albicans
IMKLSSSLLLNRSQVPRTRMNDSLYYGYCKCWDYYPDYLVTARKWKTIKKIISQTTQEILTQQFDLI

SEQ ID NO: 21276 - protein, 74 aa, Candida albicans
NSCCCCCCCYCCTARKTTQLGNEFQQMKVKFVIRFTETHFYCNYYYLIDQRITHFFTNNLNKKVIYLFIKYISN

SEQ ID NO: 21277 - protein, 110 aa, Candida albicans
FFVSYIKHVVVLYLAGNIAQTVFQVLRRCVSQVKQSYTKIGSSITLQSKPTFYGIIPQRAIMGLAKIPYNFRNVSDYGAVLISSLSRIFVELLKQVYNNDSWFLHTNQKP

SEQ ID NO: 21278 - protein, 85 aa, Candida albicans
PITSSIGILGPAWFLFRACLAIFFGPSSGQDAIYQEDHDFVQYLSNNGFDINMLGEGGDVREVCRESDSLEKGKRDDFQVDNNSL

SEQ ID NO: 21279 - protein, 66 aa, Candida albicans
FSLSLLLHWVTKNRFVNNNEEKAEHNFYNNNNKGLSQFTRNFGPKKEKEKEKDQVLFSQNDIVSKK

SEQ ID NO: 21280 - protein, 98 aa, Candida albicans
IYPVCRTFLLLEFLGVVVFFFVDKSLIPNEAILHEGVNAKFFNDPVAINNWEVVIGPTMADTLGANLANLSDINFDNNCNKSFNCSIISMTIKILFII

SEQ ID NO: 21281 - protein, 75 aa, Candida albicans
ILESLFIQFVQVKIVFNIVPTQEEYPLNKSISTLLTSNRNKKQFIYGKHSFNRYFIPSNKRLYSKYIYHKQNLYQ

SEQ ID NO: 21282 - protein, 62 aa, Candida albicans
DNRINELSLPVYLNPSIINKKMEIERTKERKTFTTRIKTNKKVILLTIIWEVKKERKKKGAC

SEQ ID NO: 21283 - protein, 107 aa, Candida albicans
YSDVDSYLGEITRATSLKRQQPGPQASNNIDGDKQIDIAPGDSTENGIPLDYINFDNGKDVGSTINSATGSFLLNVEFDHSPLTTPVKTHYTDNSNDRGSPFADPDK

SEQ ID NO: 21284 - protein, 61 aa, Candida albicans
LIVLGALTSTFVFCILFVVFFFDYITLHRHNSPALNRKNLCPAFTYMITLFTIIVNDYRID

SEQ ID NO: 21285 - protein, 70 aa, Candida albicans
LGEFKCAMQLNKGRTAKSQKKIGKRYQERRRLDSLETGLRNFNNDNNSSEQNNHPKNRGGVRIRIYNFPN

SEQ ID NO: 21286 - protein, 283 aa, Candida albicans
TPKIDLLAYDQNPMTSYPPMDKSILKNLNQSISPFNKPKLSPPPSNFPSISIDLTTIATNKSSSFLLSTTHRNYNENTPFNSANSTSGGLLPPMATFTVPTVIKEELQVHNLQEEEQEHQDEQMEIDSFESNEKNARPTLSTSSLVRSMKMANLEISNDQQMSSNEDENIVTEAVVKQEKNGPVVDDVNGTGTNSKKPRKKQKSKSKENCNKKGKVATGNGKDNDRNNECLVNKGNKTNNNDTSNDKLDNDNKNTNGNGNNDNDNDSEENSSPPGWDIRACAK

SEQ ID NO: 21287 - protein, 61 aa, Candida albicans
  UNSURE (52): Identity of amino acid sequences at the above locations are unknown.
DHRGIGNGKKWRPGGRSNTSESIDEASVSRKIPRKKGRRWGMWFIRGKEKIXNKKKEKKKV

SEQ ID NO: 21288 - protein, 107 aa, Candida albicans
MCLIKLCHIKVYLRNKVAGYNIIDKKNYNLTSIWGKNLKTLPINFLPHIFCQFKFYDNQKLKSLLQNSVLPPFVSLNFAKKHTKKFLVFQSLVNSLSITIRKLLKLC

SEQ ID NO: 21289 - protein, 93 aa, Candida albicans
FVTISSQHEDSGKDWMMSKADPLQFSKTALNVVGQLIKIWVILSRKILWCLLTFIPNFCWISNKKKHLSNKNEKPHYACTGQKRGNQSANVSS

SEQ ID NO: 21290 - protein, 64 aa, Candida albicans
GSYTRGEYLISRKDSTGHIYSISTSTTDSLTYIHLFIYLLAYLFIYSFVCLFFFAFPLEFLLHI

SEQ ID NO: 21291 - protein, 143 aa, Candida albicans
MFSLTPRDDKINSKWRRDNLLLILKWMLEPKLYLGFIEDESYPSFVYFKQAWNKYNFVLGWMFLFALRDVTAVGFRGILDKDALLQECHKMDHMRENIFLEFIKKCGKPTNLSFKLSTEEIKQLKTKRHKWESFTSIVSTIVA

SEQ ID NO: 21292 - protein, 79 aa, Candida albicans
VSVLDKLIKYSIIDFFISPTTSTLPSPSSSSSSFSSSLKISKWKHQYGKWEMLTISEKIFIKIVINYQLQKCWFIVFKE

SEQ ID NO: 21293 - protein, 308 aa, Candida albicans
FDEIIDKPILLLYISPNFTKIRKSSSSALDLQISSKNSITNEKILIMIRCNSGNLANDIINNIENALGVLLSTTSTSTSSLRTIMKSNNSYGSLNTSKLMNSDNTLASSMMDLNQSNNNNNSTSHSSTYTSFSSSFGTPQQPPPPPPRKQSYSLSSLDGNEIYNANIINNPHTIHINKINQMQIRLQKLQPNKGVDDDDDDDHDDDDYQRLMIYNPSSWKILSMYKLNVDQLIDDLTQRTFYYFKLINDEQHQQQEVEKVEDEFRWLISDEMKFQVLEKIGKAGLLVKHNSNGNSNGYGEIYMIACSG

SEQ ID NO: 21294 - protein, 96 aa, Candida albicans
LLLLFIIVLKEEVEVEVVDNNTPRAFSILLIISLAKFPELHLIIIKIFSLVIEFFEDICKSSADDEDLRIFVKLGEIYNNNIGLSIISSNYYYYFY

SEQ ID NO: 21295 - protein, 353 aa, Candida albicans
KQLDIKMDFSDDETHEYTFSSDLEDLTIDAYFSMQVTLPPNLRKLCVRAGWDSVDFISQEMVYLEHLQLKLPSIESFEDIGIIAPNLKTLVLTDCEELSNYDNLKQFQHLKHLVLTHCEYPFSLLRKGTFLELESFEYTAGEDVHPDDFTDELLTFPANLKKLTIHCCDFVNLDLENLILPSTLTQLELHHLIFDDGYFYLSENLQHVHIKATKLTFDSSFRIPPMAEQIKLLATCVTFESWDFMYHLPNSLTNLHLATIDKENPIHINQRIKWPLMLGSFTLKGFDINCNALELLNMKESRLEVINISECNIETLNIDLFPISVKNLTLMQIGIRELPASFEKSNNLRELSL

SEQ ID NO: 21296 - protein, 61 aa, Candida albicans
TITLACFLTKASNSATFALASFNLESSDMIIVGIMLLKYKKIREKKVVLLDLFFFLLFRLA

SEQ ID NO: 21297 - protein, 71 aa, Candida albicans
RREKGQSAEVIVLTSDEEDEDDRNPVVLQTPVKTKKRFNFYERAQELLHQETDNEIHYGDGESWDDPIVLD

SEQ ID NO: 21298 - protein, 246 aa, Candida albicans
  UNSURE (14): Identity of amino acid sequences at the above locations are unknown.
CKWDPPPVVKILIXEIFIGFARTHLDNCGCGKVMYRPNLVILVKDAADKTYYKISHISLSLSFDVPIIGWNVYKPDDLCFDSNVLIPYSVSNWNITSLELDIEGGRWVSNDQLTLTLSISDSTVHRLDIRGLFQSILDLADRSLFIPVDRETRVIDEFQNGLQNPGSNPLNQDVNLLGVNNDNIVCALDASVEFCFEYGAKFSIPKQEEFYEVEQQEFNEELIDPKKHQYFKILGKYLYDHALVNS

SEQ ID NO: 21299 - protein, 60 aa, Candida albicans
SLINDKSSHFKLNHLIDILVMFSANYISWHRHLTTRFGSVAKLAGVQLCRNIKLKVFTDN

SEQ ID NO: 21300 - protein, 67 aa, Candida albicans
RAVSFQKLFVQDLYLRIKNQTPPTCLSVLFYKFKSVYMICNSGGGGGGVINFSWKLSKGKNFLHIVV

SEQ ID NO: 21301 - protein, 65 aa, Candida albicans
FSTFFVFKIIIFSFSVLFVFHNQTKKKKNTTNEQTNKEEEKKINLHPPSQNRRLRIKVLKEINNF

SEQ ID NO: 21302 - protein, 66 aa, Candida albicans
DQEYKHYNSYTFIKRKGRGIIIIKNKYLRTLTTTLHKKTQFQFQFQSSYSLFLTFSPRHEIQYALK

SEQ ID NO: 21303 - protein, 95 aa, Candida albicans
EFSLVGVFFNSNQIVNMLAISLDNNNMFVNQNMTPTVDKVATIQAVSKCVFPIYELATKDFIRILKRFKYNHFTNNSVKLHTMRNRWFDVVSCYY

SEQ ID NO: 21304 - protein, 92 aa, Candida albicans
NVVKQKIISLKIEQENFFSLQFCNNTPYKLNIYNVCCTLSPTTYLNLAYPGALATNHSVTQVHIDISCSLVSSLRINYQVQTNILRARLIYL

SEQ ID NO: 21305 - protein, 380 aa, Candida albicans
  UNSURE (20),(25): Identity of amino acid sequences at the above locations are unknown.
ASLVNDAKMFELILFELFKXNLIIXSPMKYHELFNNYIFIPQHYYHWQLLTLTLKEINQNNVIFNQIHSILTTTTGSNVCFSFIDFENLLKNSFLNYKANPIVINNNLLIISYPIIFLSNYLNLDNLMTSMGQMNQLQFINLNIFIIEWYLIMMKVLIIIWDDTLIDFEDNYILQTLMYILLDNKSCLLKRLNIDTSKLEYDVNCERLSFNQKWFWIIKLKFDSIFENWMNFLKNKNNNVTNNSNVTNTSTTGITNTNHNHNDSYLHHFNVNVSNFKFNLNKYLNEYFVTGDFKFREQLDQNDPDQFQGSMSMDEEPDFTTAMQTSQTINSFMPIHNHNSRNQVYQQHNQDTPMTSRRDSTNINENNIAQTSSVISNSNL

SEQ ID NO: 21306 - protein, 73 aa, Candida albicans
  UNSURE (2): Identity of amino acid sequences at the above locations are unknown.
LXTNKYEQQQEPQQEQQQEQQQTEKQQAEQEQPDQPQEEQQQEKEQPDQQQPDQQHPDRQQQEQIQQPESLDK

SEQ ID NO: 21307 - protein, 74 aa, Candida albicans
ILKRGRPYHGEKTVFIQQERNHDSKDEVKINHKQSSGSTHHNYYCNNHSKQFKRSLMDDGSAAQIFYAISKFSK

SEQ ID NO: 21308 - protein, 75 aa, Candida albicans
RHQSRFTRVFALCNLYVFAYNSLFLLLSLVFNYLGVKILVSYHFHLLKFQVSNQYFCCSYTKASFVFLVLPSYTI

SEQ ID NO: 21309 - protein, 335 aa, Candida albicans
VVVSGCIISVACCYFIWPVSAVKKLQKTLNDSYDIFSQVISILVRRFVAGEQFTPVDIEMIEKLKTNIKSLSEYLEEAKYELYVVGKEGELLFLERLVKSTVSLARHLQALSAAIRMQWTLLHEENIISDTPSLRSFVTEDIHLSPSVLNMTHAMPLPLQDEAHNSLQLFDLFVQHLAPSIKSFVFTIKGVLGEVPFENFSEENPNRFASTTTLQYSLESAIRLFEEKQEQSFDKLYGQKIFKQNLDFDFKADQEEVTACCGNFSSLLSQFGSELLQFIKLCDRYDDVASSSRTWRWLKFWERKSEPKRTIDNSLHAAVDDLREQYGSGCLHLRS

SEQ ID NO: 21310 - protein, 74 aa, Candida albicans
RDNQNLSLIYKTIPKTISTFSPQKNNKRDGNPWELAIEISNNNKQQVSHISNIPINTLNILQLISNYLLVGNIQ

SEQ ID NO: 21311 - protein, 66 aa, Candida albicans
FSLAAFRALSTSTDNGSVSSTDRKKKWFQMTELPKPELTSLSELEKILGLNTIKKKENDSTKCCQF

SEQ ID NO: 21312 - protein, 60 aa, Candida albicans
  UNSURE (54): Identity of amino acid sequences at the above locations are unknown.
IKHKMEILCVDTEYFITVLVEDHFNFISYGISDMFGNGGIQGNKFKISLVIMVXKENLIC

SEQ ID NO: 21313 - protein, 66 aa, Candida albicans
NVHGVVVPPRKINDGDDRFDSGCQWEYQINDDDNFGSGYLHGGTELINVNELLDNYLSKSSTSTSN

SEQ ID NO: 21314 - protein, 219 aa, Candida albicans
IIIYQNHLLQPQINGKQLTNSIKDRLPLNRQIWIGFARAAMRHCGCSETMYRPNMVILVKDDVPTNTNIASGKSNYRLTHVSSFMDLGIEVLPWWEDKGLCEGKNVVIPNGISSWTIENESNNLESESSTITSNNLVDYLTITITRRDTTIDLVYIKGLLNALLLNPDNNNSNNDIDDTEEGSSIFKSSVLFNVDLVKDYLSTTTTTTTTNLHHAWKSA

SEQ ID NO: 21315 - protein, 168 aa, Candida albicans
GGEDDLPARRLRSINLNINKYPRIIIQYCHQCKWQNRAIWYLQEFLQTFASSSTLEIKIYDISIQPIFDFPGVFQIILQKESTNNKMETKIIYRRKFKNEEKYHNENQGDFVFDGFPDSKFLKKLIKMELGPELSIGHHLQKYSDDNKLYDGNNNDKNDDCKDCKLES

SEQ ID NO: 21316 - protein, 80 aa, Candida albicans
IDRSTTNRSTTISKQIKRKLKMKGDHFSVIYIHTAIRRKYDKTKVEKNFTHKHNYYFSRPQFCYTINVFAPCALYREILG

SEQ ID NO: 21317 - protein, 97 aa, Candida albicans
INLLFLLPNNQLITISVGILATNHHIGEIYIQEGEWLTEYFPIQSARRKHVNSITKLGPGKIIIVFMCKVFFYFSFVIFPAYCGVYIYYTEMIAFHF

SEQ ID NO: 21318 - protein, 152 aa, Candida albicans
CSASLLSRVLGAKWGYESHRWDGLSDPGIRLCRLPTLVPFSSTNLHTGTGLPLPLARKSRLVGTRAGAEIKLGPEPEPEPEPGQGQGQWLMSLSSKEMANPRAGSKPKAHSMAMLVTIPVARVSTLAHSTRGSKVLGSSQLYWLYPGSPLAT

SEQ ID NO: 21319 - protein, 108 aa, Candida albicans
FGGSLIITVSVPPGGAVTVVVVAYDCDQYSVVVTVGFGGSLIITESVPPGGAVTVVVVAKDCDQYSVVVTVGFGGSLIITESVPPGGTITVFVVGLELGPILGGGDSW

SEQ ID NO: 21320 - protein, 86 aa, Candida albicans
FRFFYLLTFSPVAIHDDAKVTVTHNCNSSSSDNDSLVDSLFSKEEEQEGDQIDPVTSHEEHEIESSTLVLPKMRKKSSSPPSSSSD

SEQ ID NO: 21321 - protein, 71 aa, Candida albicans
IGHSQTKSSSHQIYTKSLRYCLDTPNVFKESRFPLVPSLIQVPQQVNENGCCGGCSSLYFIENPYPDLRPT

SEQ ID NO: 21322 - protein, 294 aa, Candida albicans
  UNSURE (290): Identity of amino acid sequences at the above locations are unknown.
VGSLLNGNFIEASLLMEDELLVINETIQLLALKLNVKNPKLVILKPPEYEFNSIVVDFHYEQVWLSTGNNYTIKSISFNELVPYNSTGGSSNNVIIPLSSKKLITAFTAKDNNNTISRPIIQIYDFSKTHLAFLTDQEEIKFMKKDNSDRDGINEKVLATSLLKNFAGIKYTYLKEFLAFSHQGIIKKFIDSSELQDIIKFNVIDMDIVPVSNSVTAIEKNDHNTLFIGDKYGTLTILELLDNNNNNNNNNDYKILYQVKAHSSTINEIIYFTFSNHQICCSISRDRVIXIFHC

SEQ ID NO: 21323 - protein, 424 aa, Candida albicans
IMIINLFTPYHSILRIYSHDFTYLFTKYYIMGISVLSYNSVLFNMNINVASLITFKSKIGQTLNILNTEDVDFSVLIPDIVHSTISSSNLFDGLTDSQLVTILNKSKELLEMFPIDELTNNETTWNKWFKQYNVDSVLCNTSKLVEEDEDLRLHKFNQYRYLTSQKQETETETETEDVNELLILIARQDEQISRQINDELIEEERIFQQLLAKQEEEEELSQSIQSIQYDDDDEELPSSSSSENLLSSSLTLANSITSSSIHRIKSTLLFRKFFHNNEVSGTTEEAQGVNHSTTTNTDNNDNDEKVIRDKNWVLSLLLNNNSNIYKISITIGFIGVILHFLLIKSNNNNNNTGSNFLTTMIINPLKQFLQYEPLFTLSTIGTTFINDLEESFNGLIESSSIPNMGNFLGNIGIGNIRNTIYGFN

SEQ ID NO: 21324 - protein, 117 aa, Candida albicans
DSGYLFYFFFAKDLHGTRACLISTSFHIILRACVRLYQKIYLSRVILDKSIFIFYHNARPYVRVQIISKEFFDTISSRAIHLRQHLRLHHLQPILYYVKVVIDISVVIALIRYDFDE

SEQ ID NO: 21325 - protein, 93 aa, Candida albicans
YGSWWKLDMHVFHADPWQKKNKRDNQNPNHTETLKKELEANVTKKLAITEWPFFFLSSSSFLLKTDNIELMNHQKCLLPLKVVLQKFYYYIYP

SEQ ID NO: 21326 - protein, 76 aa, Candida albicans
TGKIIWVLIQVGQKVLPGWKILSYFKNNMNEEEKSVSMNFETGNEEFEKIAKLRKVKMVRYRGNPRKNWGPMARPK

SEQ ID NO: 21327 - protein, 70 aa, Candida albicans
  UNSURE (40): Identity of amino acid sequences at the above locations are unknown.
NNPITHFRYLLQNTNNETILDVHADERPSWFRTNIKNNSXFLQHNLKYKNKKWNLTLGIISPHPTVDAEI

SEQ ID NO: 21328 - protein, 75 aa, Candida albicans
PITTTIIIIYILRSCDCCTTIIFKMSGNDSPIPSNATVKIEQLKSFTSLQSQVTSPPKTMKQPHYPFSIFVTKYK

SEQ ID NO: 21329 - protein, 344 aa, Candida albicans
RNVSHSTNSSSSSSSLLFTNHPHRLKPIKIRLILPLPHTTQTQSNSNSLPYENICCNLIGDESFNSLSFFLKQQQGQEYGVNLINSIFVFSQYISKIDKLLLIDITTTNNQCQKFIKSYNKRNNTAGTYNNSGSDFGSGLNIVINYLINNIWKFINQLIINEKKNRSILINCLNEYYKIFKFNLIFQQQQQEREESLSINNRDQSIDEILNLSELLIYEDVPIEDLPLGNKYPQKDSINVDEFIYQTEKVFDISKLNVIIMTFDSNNKKINNNIKKSTFISSSTIMTDPYYSFDYKLEELDIGKGFYNSMNMMKMITSEFPNFEMLQSNNNKNKNIFTTAWKIN

SEQ ID NO: 21330 - protein, 111 aa, Candida albicans
VVTRASRKIPEDARHAASYRDFERPCDYSQVSFIMSHLAEKITESSLKYGFDEEQLRGNVNDAVHAMPLVTGYRFKLALMYSLNCDYSSWKANQILAESIKNYYKIDTYKL

SEQ ID NO: 21331 - protein, 67 aa, Candida albicans
IDEEGQLKQGFIYRLLLSNLKELVNKVILVFKYKKEKPSRMEMNIHNPNMYIYIDQAILKKDLIDHC

SEQ ID NO: 21332 - protein, 74 aa, Candida albicans
PNSFSGCWMLGFFWRGGEGGRGCASIIKTIFGTKLSSQISFVLQLINQSINLQKECDDLMKSIVVVVLVVVMCE

SEQ ID NO: 21333 - protein, 60 aa, Candida albicans
ETDGMEWNRWNGRNFKFKLIKSYSEKKNRTFHNNIFKCIIENYQKEKKKARGIKEFSSLI

SEQ ID NO: 21334 - protein, 243 aa, Candida albicans
YKKILLNLILFITPKENLEGIIMVKQLDIWKAIEKLNYNPRKTLQFFKILRRDTIRSRRDTKNEENTDQEEEEEQQQQQQIEDVSGYISPFDNPIIHSGKHKKRHLKNNDSISNSSNKEITIDAIIKRQQNNISSNDNNNNNNNNNNNNNAQQKEDEEELEDINKQNNDHDHDQYLEQYLNILETKNLNEFDYINSKMYERGLVEMLMPEKKDDDGKEFIEQDETIAEYWIYENQNIKGRRRR

SEQ ID NO: 21335 - protein, 66 aa, Candida albicans
HIVNFEKKKQITINIRVNNKVRGTKSQKSKTRNDRVCVLVVDNRGGKKLRVNNYLITKSIFLIIIQ

SEQ ID NO: 21336 - protein, 115 aa, Candida albicans
IMSRFFVSGYTSDSSSEEEDLLSTSEEELLSSSDEGEDNESDSSFFGEDDDESEESSSDDEDGRPSGPAYFLKKSFLKGAGGDDSDSDSDDEGRKVVKSATDKLLSFTRRWKDNA

SEQ ID NO: 21337 - protein, 130 aa, Candida albicans
IYGRHNKVLPSSISELGKPIFLHDENKESHKIYLGKWTISSTGEIHIIIENGSVSYLTFHYWFQIKSLGHINKHAKLTWVRYNSVRKPTQTITADGEETIDDRVCEIMEFSIRNEKAFKFLRVKSYTHTN

SEQ ID NO: 21338 - protein, 62 aa, Candida albicans
STTMIDYTIDIPYFISHYEHENDHDNENENLNKSVHSSNDYNNSSHGLIFYQRNIHYLAPTP

SEQ ID NO: 21339 - protein, 71 aa, Candida albicans
SIPIFEYVVATIRYLLCLFTSSINVIVLVRSIKRHVHCLGATNLSTTIQDLRFKKLLLLLIILLQSNPSKL

SEQ ID NO: 21340 - protein, 63 aa, Candida albicans
QSLGTCYILASHEITTINTTTTTTITTTTTFDSKRDHRVHGINNANIQNHIFLQDNKANSTRH

SEQ ID NO: 21341 - protein, 62 aa, Candida albicans
IFFIYFSNFAIDDYKQYYYGIIYYSPISIRLLLIITVLLLNTIIIEDITRNKEIRIIIRIIL

SEQ ID NO: 21342 - protein, 127 aa, Candida albicans
ISWEGEKNKDFHGSTPDITRATSPTITADDTAATKIDDNGWDDFNDEWVNDEPDVVDVPDTIIEPTRKINLGKSTDITTPKKLPSKPAPRKTTSLKLGSKTTKPKQTLQLNLKVDDDDNDDNWGDGW

SEQ ID NO: 21343 - protein, 66 aa, Candida albicans
LKHMVLSVNNSLKLLKIHYNLLYRVMVNMMYQIYIWDNWWLDPEDPIYKISYPCGGREGGGMSVWV

SEQ ID NO: 21344 - protein, 259 aa, Candida albicans
DAVLPAPGLIQDLEVALPILQKIKQMGDFVNIANLSNMVDLLSSLVNRVLRKFDLALIMSQWKHNFLEQLPQFLPALTCLYDLTLVVVSWKFEKLVEIEKDEQRHYAIDLEFDGIVDLVNQTIRLIYECTNSVQFLDLKTLLISRYIDFMLSFKVFYVRFQADNSFDNFQEFFNSNMQLLLIKRDMQFQLLELFLIKEVRLGHLLNVDLDRDDEEDVYYEYYTEKIDESYLQEKSMFDDDDQTLQPSTEDSSTTINQEV

SEQ ID NO: 21345 - protein, 63 aa, Candida albicans
KNPCGFTNNNLHKGRERNILRRLIDNVYFPEISIVPDIQLISFFGNYYTHDKVFTNTLQIYFT

SEQ ID NO: 21346 - protein, 76 aa, Candida albicans
  UNSURE (32),(40),(41),(42),(45): Identity of amino acid sequences at the above locations are unknown.
KRFVFQKKKFPEEEENWKVGGVGGYKYYLPTXPPSPSPPXXXVDXVEYLGSTWWRYTSLFPSPSPTLHSSICFTTF

SEQ ID NO: 21347 - protein, 70 aa, Candida albicans
LKICIVREKEEKKKTFWCVTIIFSVYFYWLQSVNFLFRKYTVYSMRIGLVFNFILLYSKKLLSFLNNHIQ

SEQ ID NO: 21348 - protein, 233 aa, Candida albicans
  UNSURE (225),(229): Identity of amino acid sequences at the above locations are unknown.
SVESAKEIHEILVSLTALENDQALKLNTILDVVLPLVATIYRNMESSLEIIQIPTSLQESLEFSGTELWNSTSSFASHLDAIYKVKLYSILLLIVYETLNPNVDRCLTNISCLLNLYSSAITNAINDVSDKCNIYLEPMIGKLMGINKDMPLKDQKRQLLNEYYHKLTILNLNYAAINNNFVLARNYESKLSSYKNLSDPFFLGECSRVLYNHCLQSVQHSVLYXTARXENQR

SEQ ID NO: 21349 - protein, 206 aa, Candida albicans
DNSLTRFDARWKKSRTKFKTKLKTKLISKLNATTNGSKSGLTDTTNKDKHKHEEKDGDEKKHSGSRGGGGGGGNSKPTISPTFIKLTNFIKYLTIIIIIMILLIYLYSISLELIGVFESITRNYSGQGGGSSKYNGFFASSKNDLNNNNNNNNFYSKIHEFTQSYTDSIPIISSNSNSNGNGNGNGNGNGNGNGNGNGNGNGNGNG

SEQ ID NO: 21350 - protein, 72 aa, Candida albicans
  UNSURE (10): Identity of amino acid sequences at the above locations are unknown.
KREQRGRKKXKQGQRNERKRRRRRRRDKINLFYLYIYIYKYKRSEYISLEENSLLLLLLRGSDSKKKKNGME

SEQ ID NO: 21351 - protein, 68 aa, Candida albicans
YFWITSTKNTCYNQYYYFFIFQLQKSLTGLTNRRLIRRIARVLLVKVVEILDLTNDSCKKSLLQNYTK

SEQ ID NO: 21352 - protein, 214 aa, Candida albicans
  UNSURE (173),(202): Identity of amino acid sequences at the above locations are unknown.
NQSLDEHSQISLAMTNKGKLSKTILKYFANTIGFSCRITPPPNTSLELDYLLHNFHKLAPLDNFQTISNSNHGFFINAIYSPCRDESWFKLIKPDENHLFEEIDSKFTNTIKNDFINKLTSLVAIPRYSYIENNKDFQNYKLQIRFDHNIQRSIANYKGKYNLTTSTVDDPFXSIINNDNANGTNNDDDDEVLIDYEKLRVXLRHNFQKIHKFE

SEQ ID NO: 21353 - protein, 285 aa, Candida albicans
ITNHLLLLMLSRVVFIILHWTLLVLADSRTTSALDITIYSNNVRYAASRRGRGRDELPWKIRKHGVVDAIKSQSGVDPILIGLQEVTHAQLKDILKGLNKKNSEDDRRWTFFGVGRDNGHKKGEYSPILYNTAEWNLLNGTYKWLSFTPDKPSKYPGASKKRIVTMGTFSHVKTGKVVNFVNTHLDHRSVKSREYSAKLIIQYIKSIPNYFPTFLCGDFNSLDTDKAYATFSHYMVDASHVAEKKYDTNLKTFSGFGNGTSYSIDFIWSPMDTSLPPPGWKDQRC

SEQ ID NO: 21354 - protein, 71 aa, Candida albicans
RHGFRFIRLKSLAKQINKNNALSHHLFGLLIQVQYVLTNHLHSYFILYNLINKKTVQSLILTIPLWHCDEF

SEQ ID NO: 21355 - protein, 132 aa, Candida albicans
IMVFQSFIRFAKYSLSSSSCRPEVRHHFFRSSYPYLNRHHFFKNLISNYNKGFNKSKWWFRSQRNTSNRSKPFLTISDGHYGLYYSMYNHDSERQQRQKDHEKYIKHMILKQLETSDRILGHKSLNSETFFR

SEQ ID NO: 21356 - protein, 83 aa, Candida albicans
SWTTFYIIYHQPDQTKLDKKEELLINSFFLFDKQNDKKKINKHIPNELVSIENSLLLKEFSENSLLLVPAMLECDVFGIGWLI

SEQ ID NO: 21357 - protein, 105 aa, Candida albicans
CHEDRRPFFFTIKQQFKKSVPIQMDTQLLSNQQLHISCAMEKYMELIRNGILLLLDNYKYNPLYPSVITISNELYLNTKLAQNLQRSGHNITGSSAPNGNGYHLP

SEQ ID NO: 21358 - protein, 174 aa, Candida albicans
APMDSNPCQDVSGDTSSTPMANNNPTNDSTISSQNHSKTGLRKHQQQHYHQHLHLQMHSHSQQSPYINQLEYFTNNQFSRSFNSLILEDANDANTNNSSTTTLNKKTINKSPPFNIKQDLLNDSIDTFLDNSNTETIEDGDVTTTDDDHDFDDEDIEDPEAVRLTRPARDQRSK

SEQ ID NO: 21359 - protein, 75 aa, Candida albicans
ECVSFQARGEDVIRRGGQSSYHFEYLCTVTYICISCDCISYTNLTIFEQHVKKKKNTMDLKNAPPMDFINVKIHC

SEQ ID NO: 21360 - protein, 71 aa, Candida albicans
KKKGEEAERKKTTRNKKRNKKIGKQRKGKSFGLSNEDIIQLFIKSLEKRNNINNRISYNTIYNIIYIYIYI

SEQ ID NO: 21361 - protein, 116 aa, Candida albicans
HRLQKNTPKPVLIQSQARKETGNAQGSNNNEGQEEGLDEEDKLLAREVAEVGVDQETLNSYGLFYNVYTREGSTFPELQPQQSSQQQQQQQQQQQQKYSAYDQWGGGFGMIPFNPS

SEQ ID NO: 21362 - protein, 230 aa, Candida albicans
HQQETNSRTQPNRFNVEPEDQLSRFQHFNYLPPLIEVPKLNSSQSSPNNSSYEGASGTTPTTTQFHHHHHHHHHHHNNNEKDQRTKPASTNGSVIRSTTPAELDGTRESDLIKLLNNTDELNRRETTPISNPLTPLAQTVEYVEAEENQKLKRRKLGPTVESNADMVSKAQHLNNDKNHDIPSEDEEELDFWETMRNLTELPNNTLNNTTTKPTVTSSKKNPFSRHYLPQ

SEQ ID NO: 21363 - protein, 65 aa, Candida albicans
FLYGKSVATFNQRPLHTEKSKFNLAKLLWRGIRKLALFTYSNVASWSVELKRYIGKYACTSDIHC

SEQ ID NO: 21364 - protein, 69 aa, Candida albicans
  UNSURE (36): Identity of amino acid sequences at the above locations are unknown.
PQAINFTISILVSLYEPQMTKSCIASNNLDLRNNSXQIRPAFQWFANSKRRILGSKIKSAFTLTIQYQN

SEQ ID NO: 21365 - protein, 84 aa, Candida albicans
YITRRKEKEFRDQSRAYLALMQVTALSNLQSIQVNSETNLTTPESTISSLSILINYPSGLILEASFPMDNPNLFVPSERGDLIP

SEQ ID NO: 21366 - protein, 63 aa, Candida albicans
  UNSURE (2),(35): Identity of amino acid sequences at the above locations are unknown.
DXEISRLRKELNLLKIDKLGKSYGNNHNNNSTSSXLQSTNLDNHQQNAFTSVSPITGRILKFP

SEQ ID NO: 21367 - protein, 64 aa, Candida albicans
SLLIIISLIRLKRCIESEVFVLLVGSGAGVSWGKQSSGITTALVRRISNKNVVNTDTFIIGLVL

SEQ ID NO: 21368 - protein, 100 aa, Candida albicans
IHCNCLISIYNTKPIMKVSVLTTFLLLILLTNAVVIPDDCFPQETPAPLPTRSTKTSDSIHLFKRIREIIINKDYARNQAAQTQSSSSTVTPPPKMGSYF

SEQ ID NO: 21369 - protein, 61 aa, Candida albicans
EKLRDRFIFNYLKLKQDYTLKFITEIMNKNQISKNKFRNPIGNEIPSLTNEVKYWIGSIEY

SEQ ID NO: 21370 - protein, 162 aa, Candida albicans
DADLPALWLNTEIHLEKIVPLNLYSDDNSELNKKLLKRINDYYFQAYYNLWHFNLCDYNNSDSGNYNIMIFKLDNLGNFNLDYCSSQGFNFNFKTAQENTINDDVNDTKEEESVRPPHKSTNYRGSGSKERGGRGGSRGTRGLRGGRGSYRGRRGNGNRSSR

SEQ ID NO: 21371 - protein, 84 aa, Candida albicans
EKKNEPNNHTFSTVKHNQLHNTYTMAAGHIARYIRHAPAIKPHVPAYVKWSSKLLGATMWFWIMLRIKEDGPVMFGLKLPFEHH

SEQ ID NO: 21372 - protein, 116 aa, Candida albicans
  UNSURE (6),(20): Identity of amino acid sequences at the above locations are unknown.
DTRRGXKLNRRCRHPEGVKXRFQRKKLPMLSCKKKFWIIFLHGRASEPKHVIFSSFNILTNQIEENVNYLQDRERSEKKKMSQTIILLALSSTTNYTIHIQWLLDTLQDIFVMLQL

SEQ ID NO: 21373 - protein, 62 aa, Candida albicans
ELKKMGQLCLVSNYHLNIISCLHELSRKLTVPKEILFLKKNNTKIVLFVYDLFPIHVYLFCQ

SEQ ID NO: 21374 - protein, 88 aa, Candida albicans
SIIVCSTINNILTHLHSIHLLLPSCLTTKYHINLSTFLTKSPMEFYFSLAYCCQKKFRSFIRARDQMLIEIVTNSYKLFFFSRWIFGL

SEQ ID NO: 21375 - protein, 88 aa, Candida albicans
SNNPFRQASISQTQPRNNFDEWVDKNKQLLDLSSDEEVEEEEHGAAIGFHQSTESFGKPSAFPHTPVSADSDSSINYARYVFNLLFKY

SEQ ID NO: 21376 - protein, 264 aa, Candida albicans
KLQFIAPACNQIPDLYNFFEDGLNLNSELSAKILAICASQNKLENKIMERREEFQNYYNSNINDSRLAFDILFLGYVGTHIEVKELDVQTLIGLLSNSQLTNDDNILAASTALGLIAQKHIDSAVPIILNAYESSEKTIIRGSLVDSLSIAADACNEDQKRVIWDKVFNFPVEFDHEVITELKKSGELLGKIPVVDELTINTDNLKTTYLILVITKSLLNNLQATKVNNTLLDSLIKSSIEWLNIVNIDIRQIVVGNLLTGLPS

SEQ ID NO: 21377 - protein, 60 aa, Candida albicans
KEGTIISSKIFLVFYALVRSTTKKKNNSEKKKNLSGRDAVGGEKKSRVPNDPELELNQFK

SEQ ID NO: 21378 - protein, 71 aa, Candida albicans
LMLKICKPPLIELMLIWMDYIKLCHIYNQDILDIKLQLCPLKSRIYYFSILEVFIDVGNGILTNYYCSIIL

SEQ ID NO: 21379 - protein, 193 aa, Candida albicans
FNEGNKYMIFHFNQKEKADSSKCKTIHVRKSIENWAIILLYILFVWYRKSELHYDHIIHTNFWGVEKNKPPFLFQTKNSIPQLFQFSIPTQPTAITQTMSYHLNILSVLSRSPSPLPQPQPQPLQQQLLLSSSHPDPAPEDDKLARESDVTVSNITLLLEAEYRGFSIHIISTIGLIIWIIWTLLPDSLSHTL

SEQ ID NO: 21380 - protein, 66 aa, Candida albicans
SSQFFPYILFDPEPPQRGHQPTFSVYIFPFINQIIEEKVVAEVKKLTTQKEREKKNLRKKNTTLIN

SEQ ID NO: 21381 - protein, 62 aa, Candida albicans
LSYPTSQQHQQLPIQSNPTFLFLKNFLLFFYYSFILFRYCLNFKTVYKLFFFLLILFIVVSL

SEQ ID NO: 21382 - protein, 75 aa, Candida albicans
ITIKIWQPKIYTLQCNIPKQLQHIIIIVTIIAVPMGHMDVNHTYTLSMQLYIEVLVQQIINFITVLFSCSPRVKE

SEQ ID NO: 21383 - protein, 81 aa, Candida albicans
  UNSURE (63): Identity of amino acid sequences at the above locations are unknown.
RYHDFFFFFLKKKTTKFPIYIVCLISSFKKKSIPSQDIQILPYNNKLNLIKLYIKNENNFSGXEEKEKLSFNLNTAKMTTQ

SEQ ID NO: 21384 - protein, 61 aa, Candida albicans
  UNSURE (17): Identity of amino acid sequences at the above locations are unknown.
MVQSSYAFGDYLIFERXIYLPKILGDLKKEKVGWFNKVGNKKELEIETGVFPFLRSSVIFS

SEQ ID NO: 21385 - protein, 72 aa, Candida albicans
KYNNAISKSRLYVKFRAQSVDVIKIIEWWLWRRWWSPPSLSSGVSPPTPFLQKKKRNPTKIDCFNLSLYVCL

SEQ ID NO: 21386 - protein, 62 aa, Candida albicans
LIYKKSKKFESKKMIKIWPNSIKKKVYKKRDKTKRFKTIQTPNKEEILIMGQVLIFLKGHFL

SEQ ID NO: 21387 - protein, 67 aa, Candida albicans
NSCQIFFKFMKDSNKHPILLQLARLSFNSTKFTLILDVHQNVYPQTSFQLFKAQNSTLDNTQLCYHT

SEQ ID NO: 21388 - protein, 140 aa, Candida albicans
QMLGSTTKRILVNSSKRLIRFNSSNNSKNGGDAAKLNLSDLFKRIDQVSAKATEFKNKTSSSRSFEAGNRRPGWQRNENDNFANKRAVRNNFNEGEQQQHQQIPKQHQQQREGNSQANFRGPRSNEFAPRSNTRPSRFPK

SEQ ID NO: 21389 - protein, 205 aa, Candida albicans
NLNNRFYPELTIHIMYSNNEDEDGDVDIDEDSNSNSNGVAIITFPRFMNTKLYNLLSRKISITLNEWINNLNWIVLTHCQLNNNSETINKLIINKINPTNTHGFSILDQIPDLAPPHSFSGITASITSQLDLFNNINIIILFLNCEGSPGYEIFDNETIINICYILIQFLNLKNHDGDNYGDKFLNNISNAIRNVNRPSNSGMYI

SEQ ID NO: 21390 - protein, 77 aa, Candida albicans
LIFTKRKNETDGMEWNRWNGRNFKFKLIKSYSEKKNRTFHNNIFKCIIENYQKEKKKSQGHKGILFTYLITTILSIY

SEQ ID NO: 21391 - protein, 193 aa, Candida albicans
SGWNFWNLHLSPTYSVNRAKNIWFQRIQFFTINFTVVVKHNKGFKLHIIDATVDDIYSSSKAKTIRDSLLSIKSASVVLTNSKRTSSLLVSPSIIMQSVFDSLLVLSAISLLSSDVTYPRIDTMSIANEANSLNKLLKQFFKIVSTNPRISSYSSCLDLNRCLFLDPSSIDLKMIINDNFNCLEVAFNHALDL

SEQ ID NO: 21392 - protein, 99 aa, Candida albicans
NFCKKKHYCFSLYIPSPTNITKTFLFQVTKGGETKKKKNSNQYQKRFLLHSYVKHTIWGFLYFYYYYCFHFCILLAIDITNFSYLFLNFFNYWHNNSRS

SEQ ID NO: 21393 - protein, 91 aa, Candida albicans
ASSDLPFAGEDVSSDSDSACACLNEQKKIRQQQLNLFLSPYKYHPKDISYLVYWFTHSIPIDSSFPHIYLHSSFSVFFYYIHYYIIFHFFY

SEQ ID NO: 21394 - protein, 66 aa, Candida albicans
YIMSGEEVINSTNRPNTIQSSGSGTSNTNYANAFNIGYQNHFFQQQQQQSLPPTQQSFQPPMLLEY

SEQ ID NO: 21395 - protein, 89 aa, Candida albicans
IYRELSTLPNGGEDEDENATINSHTSHISNNGNKRPVSISGFSNGILRKEFKKIVSDIQDQYEMELAEERLRRRKLQEQLDQSGVVGKS

SEQ ID NO: 21396 - protein, 61 aa, Candida albicans
  UNSURE (37): Identity of amino acid sequences at the above locations are unknown.
LLVSSGSITSLSQYIQSESVVIQFLTTIVPQNQLTAXENISEKFTTNNNLETIAQKKKGDK

SEQ ID NO: 21397 - protein, 64 aa, Candida albicans
TRRNKKLQNRHVNCTYSSGLSSNCCFQFTFYVVIDMDIATIIRKSDSVIFSRVRVGERMALKVL

SEQ ID NO: 21398 - protein, 64 aa, Candida albicans
FIFKFKILLFILLFPILSFPSFLGSTTTTTSTTTTTTNSITSTGTTATPTAATTASMTIIITIR

SEQ ID NO: 21399 - protein, 142 aa, Candida albicans
RRRRRRSPLLMLPSLFEFSEPEPEPEPEPEPEPEPEPAAETEAEPELGVDPETNPELDPDKPSCNSFPDDVDDDTSFETLEKYEFDLSLNLRFFFLFFFFRFFLFLLFLEVPPPLPPLLLRQLIPLLPLALLLLPLLLLLLV

SEQ ID NO: 21400 - protein, 442 aa, Candida albicans
HESESSSCANMITPPVPITGISDEIDDQNSLSSSNGDNDGHTSSSSSSGSSSSASGSNGISCRSSSGGSGGGTSKKRRKRKNRKKKNKKKNLKFKDKSNSYFSSVSNDVSSSTSSGKELQDGLSGSSSGFVSGSTPSSGSASVSAAGSGSGSGSGSGSGSGSGSENSNNEGNISSGDRRRRRRHKRRQHRGAKDIYREASNSGSDSIYSKDSALSLNKGSTNSSTNSSVIWDKDSNGGGSGGGVKPSTNSTKNGISLLSKNDKKKPINIATTNSSDKKKNNKKKKNNSSTHRHRHDDGPDQHGTNNGSEEGGDEDEDISMDEGDEEEDYVLMEEKNNNNNDDKLKLKLKLKLNNNDNNPTIQVLQKEKENIKSVVDKDSPSPPPPPPPHLPPKLPLISQLLGENFQSNTRPFGGDGDGDNDDNGSNNKLPPITKKVEKWKDR

SEQ ID NO: 21401 - protein, 135 aa, Candida albicans
NRPFVSFKVSLHNLLYQLKEPELIDDHGILSHLGNDDFQCKLSVNEEEVSNVADCFKEEKGEDVVLGVQYDVKLSYGLNVLSFNCKVAPALSKKIKNTFIEEEEVAGRHTRHQLQQMQKTWDVETITFYVVCTSG

SEQ ID NO: 21402 - protein, 65 aa, Candida albicans
FINHVGSVALNKLIAMCVCVVFCFFSKQFLLLLCEPPPLPPPEKDKKIFQLLLLLLLLIFFCFSV

SEQ ID NO: 21403 - protein, 95 aa, Candida albicans
NRLGVDKKIWAGSRLMGDVSLACPIYYLLSPLFYNSFKQRHAEILIWGDITRIQTTHTYSPCKSLDSKIDNCEDDELIPPCEKKKIIIIIIIIIT

SEQ ID NO: 21404 - protein, 82 aa, Candida albicans
LFIFQLTTTTTILLVNRCHKTFYPIVILFLNYPASYGYYYFNLYLVIIILKRRRKWWRRRRLGSLFLVLKLIYGTKCKVKEF

SEQ ID NO: 21405 - protein, 63 aa, Candida albicans
CWPRPCKDRDFLRIQSHINSFEQFRKLVVIGIQNATFCDLLAMWDLVYSNGFMMSVDITNVGC

SEQ ID NO: 21406 - protein, 63 aa, Candida albicans
LITIWCSSTGQTIPILAATAIQTAILQDTVHFPMQQEIYAITRHFTKLTLRNTMHQNNVAPSC

SEQ ID NO: 21407 - protein, 67 aa, Candida albicans
SGNRCMKRIRYHRDPTLCIVIIFKYLSLTTISPKTNQKLQKQTKPPKKKNRPTIIAEKHKKTAKLIN

SEQ ID NO: 21408 - protein, 162 aa, Candida albicans
  UNSURE (9),(20),(46): Identity of amino acid sequences at the above locations are unknown.
TGYLFMSEXDKLKQQYQAEXQGYFRPEALPPPYEEIQSQQNPYGGXTRPQQGYDNKPYPDQLYQQQQQQQQQQQVPDPLNDPNVYKIQPEKVNITLAPPEHLNPQYQEYLANEPDRFKRGDYPNKYYKHGAPLNEGHVNSSNKSNKGFPGRSGVTYHRAANL

SEQ ID NO: 21409 - protein, 90 aa, Candida albicans
TILVVFYIDRAIKITSLVYNKLSLIFLLDQNRNCSQVAKNSLKSVLKKDLGYANQKGVTLLCKRRNVVIPRNNNFNAYCAATNILWPRGL

SEQ ID NO: 21410 - protein, 67 aa, Candida albicans
NCGTFQARGEDQLELISNAQTPKSVEDIWNLKLLFEYANHIARNNKLNYISLEFIEGLKHKLWRVRN

SEQ ID NO: 21411 - protein, 123 aa, Candida albicans
IRKLKMPLKPISFRWSKTSVRLVPNPFMYGPDNLNKPLSRASQMAERVHQQTPSSTNYQQRRYFSYYYYQFPKIPRPKRNMLYYSTWSRNPVTNASNANKPSKRHMLPFGSFKTLHHEVEGPR

SEQ ID NO: 21412 - protein, 65 aa, Candida albicans
LVELGVCWCTRSAICDARDKGLLRLSGPYMNGFGTSRTEVFDHLNEIGLSGIFNFLIQSNKGVTK

SEQ ID NO: 21413 - protein, 79 aa, Candida albicans
  UNSURE (3): Identity of amino acid sequences at the above locations are unknown.
ERXGFFLSPPPSCLFLTNVYIILFIFNIFKHNVSIMPTNSYKINLKANKSIHYTLYYGTFIHTRDLTNFRNQFQYISGS

SEQ ID NO: 21414 - protein, 63 aa, Candida albicans
FGGIFIIGNPDTQEPPLVSINGYYESINVKERRKKKPKITKLQCCGNHRKSFPLKFSLFVVSQ

SEQ ID NO: 21415 - protein, 98 aa, Candida albicans
MYIILKKNKIYSVIHYILHENILCNIKSIICTFKTLGKKLNVEGARLLSTSNKISLLVYFQTLEAKKKIKNEKSLKTCTTRKKVKTGGRGDSNRKFDN

SEQ ID NO: 21416 - protein, 78 aa, Candida albicans
GVCALRFHFVYFIFLIISYLLISIVIIIVWLSIFSLQNIKEGNYKMKEEYIVRKNSRYFEDLENNSYQQQKNRTSGFY

SEQ ID NO: 21417 - protein, 140 aa, Candida albicans
NCQRGLAALWWKTVTVFLDFVKNFASTISVTLAQLLYQTTGQKYITDMMGNLPEDSQDYKDLNKYTAAKFISNPEIVQDLPDLAKSLVLSQLMKALKNVFYLGLGLAILCFITSLFTTNKKIPKNVEIKKNDDEESNKNE

SEQ ID NO: 21418 - protein, 63 aa, Candida albicans
KQKSKKFIYSRNPIKALKTTATKILGVENTFTPCAHYVKDSQNMAQSPITMMNCGGFVWFELT

SEQ ID NO: 21419 - protein, 69 aa, Candida albicans
  UNSURE (61): Identity of amino acid sequences at the above locations are unknown.
KLFVRLCFLVWKLKEELRSLGFFDVYTFFTEKFKSNSIGRSFPWTESIFVYVLKSYFVFTXAEEDPNCV

SEQ ID NO: 21420 - protein, 171 aa, Candida albicans
TNMPNKIRKLTPCKTHSDSISIEALMSAPKDLISQFLSLIGYLLPITYSTSDALYLRPNYDQYQDRQNINQTRIELCTQLIPNEYWKFVNDIWSLLILSFQATMDFEIRRKGFVNLYRIICSNESDFSLIKDVDFIAGLLANVVTQYQSIVIKEFASVESNDDYMVSTDVE

SEQ ID NO: 21421 - protein, 65 aa, Candida albicans
APMLNKMMNLVKLVHPKKTNTTIMININTMMLFINMNMKSFLSYIVEVHLVFKAVHHHYQKMSIN

SEQ ID NO: 21422 - protein, 176 aa, Candida albicans
LYRPLITSLLLFSLILSYFSLLYIFLSSATYIPPLHPLLSLYSPNQWCTISLKHIKYQVVYPGTYTGGPNFVHQQYPYYVSSSPAQASQQYIIPPVVGQPHLQQQQLSTQPPAQPKQQQQPVPSHHFESPDKTTGKSEDDTTPNKRHKNSKGGSINFMITTPKNPPKKRYNNSSSK

SEQ ID NO: 21423 - protein, 97 aa, Candida albicans
LNMPKRELLVRFLLVVVKSQDNNWKLSVKLLRDKSKKFNLLPERGVKHYSKKNIWSILANIIGEFKECERESRTRADVDTSTLWESLEYWSILHHLG

SEQ ID NO: 21424 - protein, 85 aa, Candida albicans
YKNIISLSSIGGYGGSDRLLNPRSFPLFFFTLARYVFFFIVSLLTYLVTCSSNSNKISHLQQQLLLLSSISNDVLSAGLEGIAGE

SEQ ID NO: 21425 - protein, 62 aa, Candida albicans
SDVATSSDDNLISINQINNKTNDNNTIATEVHNLTEIDKIRTKKVKNSATNSTIKKTKTFIL

SEQ ID NO: 21426 - protein, 174 aa, Candida albicans
LHFLIQFHLSIDSQIHIYTHIYIHYPYNRLSSILVSTIHYYQLTMSRINNNNDKSSILSNITTTDTTTGTGTTNTTTVPSIKTKRGLSYILGDSNSNENHILPINSIQYSSSNRQLYTAGRDGNVKVWQPHSIQPYSNQHSGNNSQDDLFSDCVDLDEKLLRLETSISSNPLSY

SEQ ID NO: 21427 - protein, 66 aa, Candida albicans
  UNSURE (53): Identity of amino acid sequences at the above locations are unknown.
DIIKLHCIIYRHKWHQHGENEYGQRILTQVSRAALCAKDQAGENIMNLTRAIXEPMEREEFCSEQE

SEQ ID NO: 21428 - protein, 69 aa, Candida albicans
HPNRHLDIGTMEMTMEWVKNENKSIWSSSQQQQQQQYLQPLTEISSSYIVSSTATNGISMERMNMVKEY

SEQ ID NO: 21429 - protein, 62 aa, Candida albicans
CQESQSTYVESLEIANYVYANSSTKLNVNVYQLYNIHFKETNNFWTAKNGLKICYWPITLVK

SEQ ID NO: 21430 - protein, 64 aa, Candida albicans
LYVRTLTLLTLNKQIKTHFDDRINGTENTIKELSVLYVPCSNNGKISSDSEVTIDVRIVVLRTA

SEQ ID NO: 21431 - protein, 78 aa, Candida albicans
HLSHQLILQLSSVVLEISHRIMISVVQDQVTSRKKNGFEKYRKLVNRSLMSIYTKKFDSSLEITIMAHPYKMDSLNTG

SEQ ID NO: 21432 - protein, 114 aa, Candida albicans
NLCFSKSWWFFLFFLTILFHFAMGEVEWCYGDIRMYAVLVSDPEKTHKKNLNLFFSSSFLEIVHIFFRSHRLVWKLEFLQLLPNNKKSKKTTSIRYLYLHTDYIARVFCPLLTI

SEQ ID NO: 21433 - protein, 77 aa, Candida albicans
FSINAPSLVSFILFFFFYIILTTISNMSQDNVSSTSTAEAVNNEIKVKDEFPQEEQAHTSLEDKPVSAYIGIIIMCF

SEQ ID NO: 21434 - protein, 91 aa, Candida albicans
LNIYYVVVVAISKDWMFLLKSLFKNLLNISKPRKGMQKRIWKNEFPGIEITVTIVSPRVTNFSFFKKWSAVYSACQELNVVCSESGSHVTT

SEQ ID NO: 21435 - protein, 89 aa, Candida albicans
TVRKYCVTGLVSIRVNQLLAVVKIILGFGECNIACWRQRKQDCEGIRYVGYFFQLAYWKFKNRIVCHIPANECCTHYVILRILAIRACA

SEQ ID NO: 21436 - protein, 179 aa, Candida albicans
  UNSURE (167),(172),(177),(178): Identity of amino acid sequences at the above locations are unknown.
KNFKTEKKIFHFDFLSSIIVSFKMELSYRSYQKVLNISLKPKTTHACSKKATAAATTKKIAKPKRDETQIKRRTKTGCLTCRKRKKKCDEDKVNGKCQACTRNFLDCCWPDPNTIKTKNTKPQQQAQQSTEVKPQISPVVRPKKCDINYLVHSKPELLTPVTQLCYXTIEQXGAKVXXE

SEQ ID NO: 21437 - protein, 67 aa, Candida albicans
LTARFQLQFVEKHLRKWQLTQNQVIFSEGDTTQLSENGKNPSKKKKRKEIECHLTRYHAHPRLCQIF

SEQ ID NO: 21438 - protein, 88 aa, Candida albicans
IYQKYSDLKTPSDNYTDRNLLLNGSHEHLMEDELAAGIQQMKLHDNIYPQHHQGLFSDDHHNDDLAQVDFPKFGINNDGSRSIFGIPR

SEQ ID NO: 21439 - protein, 62 aa, Candida albicans
CDMIWYCLFYFVQRVQIERLQTMIYNGDDENTIGENKKEKTRNLKLKTPKPQNNTNSNKTKK

SEQ ID NO: 21440 - protein, 115 aa, Candida albicans
CTTGDPLIRSLVVLVVVVVHCHSLLVVYYFWDVLAVDDTYTAAALQIVVAVVVAVVGVVVVGKRDLADRETPDTSDSSSWDMSEETDSKTVVAQESAVPYIVAGETVAGGSLGIG

SEQ ID NO: 21441 - protein, 82 aa, Candida albicans
NTTHTCSRLIYVVCEWTNMNEKKKRAKIFFFSGADHHFPPTLISTAPPTPRTDTWYSTLFIVHLNASALSQNQQHPPSFYNA

SEQ ID NO: 21442 - protein, 76 aa, Candida albicans
CHKFEFEFELKFVPNLIVKIIVSLSIDIYCRSSTIYKPKTKSITKKSSTPQKKKRATNNSNLKSSSKGEEGWGVGG

SEQ ID NO: 21443 - protein, 61 aa, Candida albicans
CLQIFCFVMGNLKDPPVIRSLYQQFKYRPRGKSVVGKFLYLKLVQRYLDDIIAYWHLLKSF

SEQ ID NO: 21444 - protein, 120 aa, Candida albicans
NERPHQLEREQENKHEQKQKQEYDFGIKHQHEHVDVKVDLKLGERQYQQQQQLGLGQDNNNTPRKNNVIQSGVDPNDDGVHHLTKVVSDDTTRTDKTVTKPNQNFIGQGFGKEEELKVQF

SEQ ID NO: 21445 - protein, 74 aa, Candida albicans
YNLYIHIYIYIYEYFLEMFYNKEYSRNVRQREKVDLTFCGEENMEGVLIKQYQMILYRNLVYHPKWQRYHQHNF

SEQ ID NO: 21446 - protein, 183 aa, Candida albicans
LLKFHLNNGTEGNAKFRNLYNETAAQGLPKVVKCDSLTSDNYFTGNVLNDYFANFTLLMTNGSATYCSTAQEDNATLEVMTRLAKHGLVDYDRIMIMRTISDFSRPPPSMSAYEYFFNRSDGGISASLENLVIAGTPIIHDIVQNWDKIYESGEKYSSKNYVGDIFATLGGKPDFGKESFDTA

SEQ ID NO: 21447 - protein, 65 aa, Candida albicans
PSSYQECIVFKRHQTECLLGHKLREDSAAGGDEIKQIAIILHYYLRSIFQFRSSKVSRVKRYQIS

SEQ ID NO: 21448 - protein, 94 aa, Candida albicans
FGDIAWTYSQMYTKMYSHPTYLLLPIESIVKVITTNQLKQTTLCIILLSSSRHVTSQLIVILLLAVTWNNPEQLFIVNEQEPPYRNTLLFITID

SEQ ID NO: 21449 - protein, 76 aa, Candida albicans
LGYMQDTNYVSHSLDFFLFNRPIRNCCWLRRRRRRRRRRGHLILLFTRTSSLYFKQVNRLIKILSKENLRVLYSVV

SEQ ID NO: 21450 - protein, 138 aa, Candida albicans
PITDAIHIISIVIYGALEIAMVSLSNLLVCLGLVVVPTTLAFSDTAPIIIHSNNQDALESNHKYITKFVDVKSKVDEIIKESCSDKNSKLFIYQIEDLSIESENSWLWTKGSYANVLYHEKKDAHYDFNGKGEKTGIW

SEQ ID NO: 21451 - protein, 262 aa, Candida albicans
QNQIKTMEKQYQVQQRQQLKLLKNDNNTRTPTPNPNLTISSNSSVILPPSKKSTPKTSPLRKPPKPTVTPVRKMASKRPPSVTNTPEIKPKESSSEPIISESDFEDLEMDDKLTEEVPIIEFNFDNYDNDEDKKEEVVNKSKNENQNITKGMELKPKPKPKPSEETSKTKVKPQPRKQKKQKKPLSEETVDLTDDLDDDFKDLEDQLEELLEEEEQPKQQQIKETKSNQSIQKKPSPTIEVDPIAFNESDENDFEKFHFPGY

SEQ ID NO: 21452 - protein, 62 aa, Candida albicans
SSTRHMFERLYVIVVVANLSVRDMNADDFFSGGGGSTYTSEAHECFGVVRGFSSFYFLSQDD

SEQ ID NO: 21453 - protein, 133 aa, Candida albicans
ILLTMDSAEENEEDANEEKEDVEGEFSDATLEAELDGDDDEELDQDDFDDDEKAMFAINDEDEFEDDEIELKMLGDDDDDEEEESEEEEEETKKRARENDSHSKKKSKKQRVKDLPIFASAEDYAEYLDSDNE

SEQ ID NO: 21454 - protein, 61 aa, Candida albicans
IFFFSNCFLTKNKTGNNYYLYTARWDSTLPRPRLVFASPCLFVLQLSHSFLDTNITIFLIN

SEQ ID NO: 21455 - protein, 61 aa, Candida albicans
NMETFPPTIGWKGLKPLKPQEIEDNLLIEKFSTYSLYSVVPYDCYHSLIGKTTKSSLGKGY

SEQ ID NO: 21456 - protein, 102 aa, Candida albicans
  UNSURE (16),(64): Identity of amino acid sequences at the above locations are unknown.
LFEPLTKVAIAPVKVXPCPPTRLLEPVISWIKNLDELNIHFVFTFTENNKVHLSWGDTSRGVIXLTYPLFGSETIGTQLNKGLGESLGIPTTLGVWKEALSG

SEQ ID NO: 21457 - protein, 204 aa, Candida albicans
TIIMDSASCGPSTALQNLNKHAQRDNSLQHQRHQHPQHPQQQGASIHQFRQGQQVDSRLNADFKQFNNGNDFANSFMNQMNIKPSMQQHQHQQHQHQQPAWVNDFSNLSIQQQHQHQNQQQNQGTKSDWHQQFMQQQQQQPNTLQHQSNFQQMTPNYAMGSYQMRNTATTMTPMFHNQTEHQQQHKLEEEQRILTHPAGFPSWG

SEQ ID NO: 21458 - protein, 61 aa, Candida albicans
SDGVGGIIRYTFLVCILFEYNDCLLNRGIALVSRYWVILPQPFYTLNNGINDPINTGPNSN

SEQ ID NO: 21459 - protein, 159 aa, Candida albicans
LRICSAFIPIYYCPILKMSEILKANHRKVYGNVSNSSSSSSISMSPSGSATNKRSTRSAGDNRSKLSHDMVAGAASFEATRLFEDRHRRNGKPVSHAFARKTLIALAASEVDKLFEVKELTHLDKDQIKSEAIKAIEKEYETHYGGQRHWSPNFKPISW

SEQ ID NO: 21460 - protein, 90 aa, Candida albicans
NHQKNPIHRQSVNITHQAMLQSTPKSWKDFLKSPKKPTSPTTPPGSVTITPNTTPPSVPCASPRPAKIPSRDPFQTINRFHLRELRIRIS

SEQ ID NO: 21461 - protein, 110 aa, Candida albicans
YDSVYKGNHEAKFSHEAVAGAASFAAVKLFEDRQRREGKPVSHAFAKEALAAIAGGEVDKLFETKGLDYLDRERLRDQVINNAQRGYDDHYGQHEEWSPEHRPPFDYQRY

SEQ ID NO: 21462 - protein, 90 aa, Candida albicans
LFPNNPPPLAIPELPKSPPEEEPNVVLLLLLLLNNPPALPNAPPVVLVFELDAPKRFEVVDAALFPNKLVVAAAGFAVDPNKLVVPLVFV

SEQ ID NO: 21463 - protein, 143 aa, Candida albicans
LLLVLELPNKFRVPPPDVEDELPNKLVLAAFEALFVELPKSVPEEFAALFDEFPNNPEPAAVVVVLVFRLPNNPPPPPPPVVFPKVFVDVDVDVVVAVGPETEARRPKPEDDPQLFPLVLPVLIDPDPKLKDIIQNLGIELLL

SEQ ID NO: 21464 - protein, 60 aa, Candida albicans
CKIFLFLVYVRLLLLFFKCCCLVMKIFLLLLMWLFAHPAPHSNKNAITNVDVIRKKERTN

SEQ ID NO: 21465 - protein, 143 aa, Candida albicans
IKESQISSMGNKAKGVKRSADKYNNKSSKKAKVAEKLPSLSSESEHSEDQIEESDAESSSGDDLDISEDEDELDDLDDEDAKEDNDKEEEDEEEEEDQENGNSDNIDPNKKSSKEQHSEQKKVLNERKLQRSSPRPWKDPQLL

SEQ ID NO: 21466 - protein, 95 aa, Candida albicans
RIIVLVKSLATAKYDISYTIECLPTSLLQGLVGNPTYSFQWDNINWIATTITVRKKTRPNFDFPHHVSRIKSWYPSKKLFHMNLGLIGYTEFYYV

SEQ ID NO: 21467 - protein, 77 aa, Candida albicans
QILHLDLDPDPKSSSSKINKRKFESEAERCRIIEATYLHAYIDEILITIQIKHAIKVILQSPPPPKTYCRLAGSFIS

SEQ ID NO: 21468 - protein, 121 aa, Candida albicans
HFLIFKNLSLYLFLSTPGLSQSIFYSLTMYTTNTLLDEKLFLLLQKYLIYHQPFTNTYQSNRYIYIIDKYFCKFIHNPIISSIILILSYTYYYYYYYYNNDNYDYDDYYLPQYLCSSTRSC

SEQ ID NO: 21469 - protein, 64 aa, Candida albicans
  UNSURE (24): Identity of amino acid sequences at the above locations are unknown.
WREISSLFWTTCYSVFQDNGFLAXLLFTPLHNRSVANVHISQFAARVTQITCPKPTTNGFISVQ

SEQ ID NO: 21470 - protein, 98 aa, Candida albicans
ITYFHRDVVSGDNIMRYNRIPKTRKKTPKNVSLLYNLFYEKVNPYLLVIYLVCIYKIMFMWSANCIAYHVHAKILYSPDCKLCALLKDFKHQEKWFMQ

SEQ ID NO: 21471 - protein, 64 aa, Candida albicans
  UNSURE (53),(62),(63),(64): Identity of amino acid sequences at the above locations are unknown.
SRLGNRKSRQLPRCKEPGFVAYTLHSPNSDDLYSATGAGRNRAPPAVSAPEAXDHPARQPAXXX

SEQ ID NO: 21472 - protein, 63 aa, Candida albicans
RNYKQKKNISPEGESNTRSLDINIQNEQLQSNALPTKLSRVILMCYHVPGLTDENNFITMLIN

SEQ ID NO: 21473 - protein, 168 aa, Candida albicans
TTTDSSSTGFFQVPNRDYTPSPDNNTLTRTLSNTSKKSSPLPPQTTSENAFRGDGQQSQSQSQLPLQQQLQPRRGLLFDEEDSEDSEDEGMVIGGKREEKKLHGQGYNALSQVAGRNGIHSPSPQFGNASAHLQDQDQGHENEHEHEHEENHKNLVGQARGLAKHFFG

SEQ ID NO: 21474 - protein, 128 aa, Candida albicans
GAYAGFLSPWVRTELIKINQFYNSKESEIFKIYNNLIHDLQNQNINIDDVFKFTQAYNYSDPNIINTDDHHQYHLKSTLSRTVTNASVFDTINHIDNDYDNNNNNQKNNYDLEKQNNTTVAIHDDDDS

SEQ ID NO: 21475 - protein, 72 aa, Candida albicans
HDADPAIPWGRLSSLTTIWFVVDARRWYVGPRTNISEEDIVYGEKTEDEGDEIPDVIDGQKVSISGTEKRYQ

SEQ ID NO: 21476 - protein, 69 aa, Candida albicans
VFYSCKYGSVLLSEKYFKKMSHYVATLEKCEDLETIEMKQPKRKKKRSPHHFKKILYLQPNNQTTYEEL

SEQ ID NO: 21477 - protein, 397 aa, Candida albicans
FVHCMTCTTSTARTSKQFVKKRIPKKRQKQYFQSWKEEAALLKQKLANDPTFRFSKDKSQQQQNKDKDKDNNGDTNGGDNDNDNDIIIEKIIQLRGSSIFPQKQEPKIKKPFEHIDYSKTKNKIPPTSKHYTMDDFFKPKSENKSDNNQSRKRKRQRRDNQCTLNLTNNGRLTRQVESEPQPPQPEPEPEPQVELVSQLVPKPQAEAGSELQPELESEPQTEAGPKLQAESELELELELEPEQQPQPEQQPQPEQQPDSVSQSESVSEPQPDSVSQSESVSELQPESEPEIRTDSEPEPQSQPQSQSQESSVHKKLTDETEQKESNQLLTRKSDILNDLVLNSSEEAIDSVSPNHSQRKRRLSSLFPSSSPSPSPSLPQFDDGDNFQCDTIDVTESP

SEQ ID NO: 21478 - protein, 63 aa, Candida albicans
SKISILSCYIRANKRKQQQEREKKILDVKWNIFECNSVYLIPIEKRKRIESCKKLYLNSFDKP

SEQ ID NO: 21479 - protein, 147 aa, Candida albicans
WGPVSSSQVQPHYYLPPHPQPQQPMVLLPSQEFTFSQPMQYQYPPLPLPLPQPQQQHLDPMPVQAPVSMQSISSISSFTQNSGSSNSNNSLINGMSIGMNSTSVVTTAASTVATADVQQQQQQHQLPMMMPYYPLQPQANSQQFNLF

SEQ ID NO: 21480 - protein, 68 aa, Candida albicans
SHLVLCINLNPHYTHLHTHIPIYSFILLLSLIWNKSVLLFEYYIDFVVLILYPLKKNKKLIVMFIPII

SEQ ID NO: 21481 - protein, 71 aa, Candida albicans
IYVSRVTTYLKLDSKTTSVSKISLFISSLIKKKYSLYIHTILNSTIIIISKFQFVNVHVTLYIYIYVLFWF

SEQ ID NO: 21482 - protein, 65 aa, Candida albicans
NSNTKKNFFVFFLYLINKKISHYVISFLFSIIILVWLFCCIQDTYTVALFNFTQVWKLLTIFFSS

SEQ ID NO: 21483 - protein, 86 aa, Candida albicans
CKQKQTFLKVQEGKEAIEEEEKDTVPNNNNYPLEWCLKIFTGEIYIYLKYSTITKYRFVKFSFPFFFLSFFLFFFFIFQLHISFFL

SEQ ID NO: 21484 - protein, 254 aa, Candida albicans
SAGRCENLSKSVVDFTVLEAMIQMVGTEKARFFLTRYIQLMNLYDGRLSQIELPWDRKFDKSSAYKGFSSIADYTRYLCTLLPTTSIHQISLLLENEAKRNPQNTFQIYKKELLDKALSPNKKCLGVLLAVAYDYGDFEAWDRYRAPQVAIREFQRHVKTTKTGIEPNEWLWNKYIKLLLKYDYISELSKIMKWWDDLKFEPSKGLLLLLLSALPREFSERHIKHHEKLQLKRDWPWPSIEEFNAFTVNRDTMK

SEQ ID NO: 21485 - protein, 295 aa, Candida albicans
NVQRRVEYIIGENDSESINFNTDRSGYDKFTKVRTESTQEEDNANASLPSIPETIDAVMPSIQEDGASDEEEQDDGEEKNDIQDYHGDSHSVLPTMTMSSKSDSVLNEHFYPKPLFKEERLTPAASKEDLLPQKYSSLLPSENRRASDSSDVTARQRSESTSTVTTNSTVQVTPKELVPDKYPVSDWKSIVTISQPVDRIAAFKDALHKEQQYDSKLTSWLHYALKRLPNTSTNLLIGRVASQAYQNAEHNDLRRHASFRSRVNIVKDKVEGTGSFGKKLFSRSKKFIKSTTGDK

SEQ ID NO: 21486 - protein, 94 aa, Candida albicans
NYESLGDCQKVYKGLVSSGVSVIKGKLVGCVHFFLVPIGTVFFYSKFWMRPTTTNPPMAEKGFYGDYFYSFLTRLILKHRILHYVVYKIHSTVT

SEQ ID NO: 21487 - protein, 65 aa, Candida albicans
GTITFIKAIHVYTNNMCRTQSRYLVRSILANHCVLASTRMAVSPILNQSIKFYSSKKHATDKSQE

SEQ ID NO: 21488 - protein, 94 aa, Candida albicans
STGRSANFVNLSSISFALFTALNILGSLNDLTGDKTFNCDKILKQGSAARDVTLNIFHGVIWFCSSRIKYFKIMVLVEKKKSITKNIESCTYAK

SEQ ID NO: 21489 - protein, 188 aa, Candida albicans
KMFRVTSRAALPCLRILSQLNVLSPVRSFKLPSIFSAVKRANEIDERFTKLAERPVDYKVMEIIKQIDTEPELLFQLGFFFYECKRIGITQDLVNNRKRGVLYWPIFLGNLIPLNRAFWETMHLMNKAQHSHRLNPFKINEIGLLDPKNFPPDFYKQLLTGKYNGIDFRDTKGFSVSKPQWEESKDPV

SEQ ID NO: 21490 - protein, 69 aa, Candida albicans
NIPNNTLNCYVEYTFNSFVYNLLYVYLFFSRRFIYKLSSFLYSLTSNLGLFMDLFLLEVPDDDSSKAVA

SEQ ID NO: 21491 - protein, 154 aa, Candida albicans
VGSSPPGEDAAAAEVKASTEGEATKDATATATATEGEVAPTATETKAEAEAEAEAEPVVVAAAAEATPKEVATEEQPSPSADITEEVAEPTADKKEGETETEGAATATAAATEAKDAKSEIKDSAEKTEKAVKKNEFFKKFISKFKKNSHAAKN

SEQ ID NO: 21492 - protein, 63 aa, Candida albicans
SHHHFTTYISLYLSIYLFLIVNFLSYFILFYSKFYFLFFNIYKLGTFLFSLSHFSSSGAYHSK

SEQ ID NO: 21493 - protein, 75 aa, Candida albicans
  UNSURE (70): Identity of amino acid sequences at the above locations are unknown.
QFLFWLVGFFFLCWPIKFFLFFFSSSLPYLAVDVVVVSAEYGNENYEKKKARTLNARLTSCMAYSCGYSXNLILN

SEQ ID NO: 21494 - protein, 99 aa, Candida albicans
LANREKKIQPTKTKIVKNYTNRHKTNKLFPSNYSKSKQNKKTMQENVVQIDFHLCTKQVLFLPVGYSATTNHYSYVDPVIIIEIYILFINNRVLSNQCW

SEQ ID NO: 21495 - protein, 87 aa, Candida albicans
CLPHSITPHLSSSSFIFQSLNITLRPSQNFFFLTNNPKLQFSFLLLLYIKKFFIINFTTHLISNWAKIESNFITYNQKTIQEQYHYY

SEQ ID NO: 21496 - protein, 64 aa, Candida albicans
SLSPRSASPSPSPHYPQIDLSHLSGVCHTNLGHFGYDLIRSFINLSYDVGITTNQLLSNKLYSH

SEQ ID NO: 21497 - protein, 63 aa, Candida albicans
SEKKKRKKALGLIGCCTNTMYNYFNFIMHEVFILVFIICSCFRLNQGNLSNLITLYFSAYVFV

SEQ ID NO: 21498 - protein, 95 aa, Candida albicans
VSKQCLVERLNHTCKVVKMEVAVNLAQEQGQLRAEMRLWSTFDVAGTVMDMARVSIADNGIIVVANVAVVCSLRDYVADENIVLTRLIVVSMQIK

SEQ ID NO: 21499 - protein, 65 aa, Candida albicans
RRMFSTPILYYNRKITKRSLKIVQTVEKCSYFVKGDEEYIFWNNDDITNPQYMLMTHKHNHIPIS

SEQ ID NO: 21500 - protein, 61 aa, Candida albicans
GMMYVEYNQIFEYVLDILIYLDSDKTTYFTEKLIYQTCNIFNLTFSRYFCIHLDVFSVLLC

SEQ ID NO: 21501 - protein, 75 aa, Candida albicans
VGNHHLYLCSDKRTLEYLTLCNNVLFRIYLHKRICSMEIMKTVLSTHRMFLKDFANIIIKQAFSLSSTCSYSCRK

SEQ ID NO: 21502 - protein, 72 aa, Candida albicans
DSHRHQYDDHNASFVLLFFFFDTLNYGINEITKTKAVEPNEKEISVLPQNNKKNYETSHKHPTKTSMILNKY

SEQ ID NO: 21503 - protein, 96 aa, Candida albicans
ETKKEMKSVIDILSNFPENGKIILQQSSKENQELRQNQQQIQIQRQYNADKSIIRIPLADEEEEEEETNSHPKLRALKEGEEEEEQETTKRKKTQQ

SEQ ID NO: 21504 - protein, 303 aa, Candida albicans
TTNSNMNNTTSSAQEKTVKKRNRATLVCLSCRKKKVKCDKGKPCSNCNKSQPDKCIYDERILESKKRKKPSMTKPEPNGTNNSDATSSIPNVTSQDKEQQQQQQLAKERDVCVLIQKSELQELLAKLKQYESLENHTTTSNHQQFDIPAESSNSSHHHHFHGIKNKNDNIVFNNSSETRSSLVFTKHDETRPGFIPLVNVTSEKPHFPEKRITTTKALELSKLPTEETNLIGINPYDHPDDVIDFHKQLPNTFGKNENSTMSPLSWSYAIRSSSIVRTLRYFDSLQYQKDVEKQVTSEITHNN

SEQ ID NO: 21505 - protein, 71 aa, Candida albicans
KPRKERLNKFEYWKLLFHSKKLKVRLVRGFLINAINLFKISFNLIFTILVKQRRKFLNIYTYTHQFCYKRT

SEQ ID NO: 21506 - protein, 60 aa, Candida albicans
LIYKFQLGELVSTSSSSFSCRALKLILVHVVNIPPFAVIILVLITHNISLTHSASSLIFF

SEQ ID NO: 21507 - protein, 215 aa, Candida albicans
FILFCIMSQQQQHIRKSKRTRMLTEKAKAETNTISLVNHKLPTTTTTTTRKKSFSLPKTKKRKISSIEEEEEAAKLSDKIDPVEKLLSLTNVNQDFLLDWEDNSHRNHHTSISSSSTSNNGITSGSLISSNTSNCGFSPRSGYHSSSSSISSLFSQNEESEIDEYDYDYESEDYEEPNEIESVNFTKIIQDNIRQYYVKRRLENLYRRVHHGMED

SEQ ID NO: 21508 - protein, 320 aa, Candida albicans
  UNSURE (267): Identity of amino acid sequences at the above locations are unknown.
TRVFILRGARPITILCQPIIMCNDNSIQMLFLEKFYHDNQGNFKYQNLIKVESILLQKFVNKNTNLDLSSSSSSMKRNDLIEQFLRIVLTRLYPRYFGHILPSIGGGFGGFGGVNANHIGISNKDNVGEMTSSLNVDRIVKKVRNSMMPITVGKIGLLINSIILFLLYVLLHCCPKILIWHYVNLGSLYLINLLNVAFILMILISKSQLKTYSTKDFGYILIVFEFLSILSIMVLFFHDHKSIMKRQLFVAYSCSSSVYSDHMDKPXTANSSGHKEINGNNLFNTLTPTPTTTTTVQVSSSPPSLIPSSNSPTLSYYPQP

SEQ ID NO: 21509 - protein, 172 aa, Candida albicans
SENLYQMYSGLVLSLFVSQILHLISAHPINDDNSIFIDNRDPTTPIDSEIYSNLYTYAHLIDISYCISEVNRIEEPFKCNLNCEKRFPNISLVYQFYFDDSVTGYIAKTTSNIFRYNETLAEDKKTIIVALRGTRSIFDTLTELKIDMIPYPNMGTKLPLWWIRLLSSQRIS

SEQ ID NO: 21510 - protein, 97 aa, Candida albicans
KFYKLGGGGKGIKVLGSVNEAKHNEFKRKFLRVIHKNDVITTLPRDQNIFNRYSQFDNQIYLNCSETDTRPTINEVIDCYDGSTNRLLSQERPIRKK

SEQ ID NO: 21511 - protein, 73 aa, Candida albicans
NSIMTKSIVNSYAMRPKTFHSNTGFMIYSYDLCKLPRLCVQYFNPFKEIFAFGYNFIVSDMNQLVSSSNSSNS

SEQ ID NO: 21512 - protein, 70 aa, Candida albicans
TKNNHIKGLNNHIDFISNEYQLLYNDYEELKHSSLLNRKQELLKECESNKGHMDMELREFEQFLVDAVGN

SEQ ID NO: 21513 - protein, 185 aa, Candida albicans
RPNGKRRPILSTSVEEIANFVKENFCLHQPNHERSFRLKTRSSVSSLGRNKAEDFDYRQLSNLFEELMTLLSHNLQTAEPSEVSLQALILSAWKHYNAYVRFYLLSIFQPLQLHLNELSMRNHNGSKIIRIDDLLLVSFRKVFITEQGIGSGDRETSQFLGNTESEDLTGNGLLTSTLAVLSSIS

SEQ ID NO: 21514 - protein, 98 aa, Candida albicans
LTTTIINIIIIIMSQTNSFMHLVRPNVIAPAAGSANGPASIKIHAPAMLTILEIISQQVLNKRIIGTLLGYRSDEDLEMEIKDGFMIHINATGDSYRH

SEQ ID NO: 21515 - protein, 87 aa, Candida albicans
SMIFIQRGLIEHSTFHAIYLNVEFLNEKNQVIELKITTYIVAAVGKPVSNTQQIGWKTTNVNNSYIFTPIHNEVINATITEKIAFKT

SEQ ID NO: 21516 - protein, 116 aa, Candida albicans
IDQKINQQNDNTNTNTNNNNGNNNNTDDLSYLSQQLNKATDNVGQLLSYIENNGNKDQDIDLLRLLSNQLLNKPDILTNLPELEKLFKDHNQDVIMIEYLTKAVKDQIELSDRLTD

SEQ ID NO: 21517 - protein, 71 aa, Candida albicans
FRNHIKEKKEFNPYTTSVGEQVETYGKEKKRINGLPSTHKALSWATSKNLYEQKDVKITNKKNYTISHNAR

SEQ ID NO: 21518 - protein, 74 aa, Candida albicans
RINLSELSKSYLNFLFTPPANGYLSKTANNLIGILRRTFQPLNESIINRMPVVFKTLIRNSWNKTNSKTLNKKM

SEQ ID NO: 21519 - protein, 60 aa, Candida albicans
PLTLCLTISINLWFSYLMTTKVVNYSSSESLCIGSIYILKRTPFVNEQSRTTTYSIASTF

SEQ ID NO: 21520 - protein, 100 aa, Candida albicans
CCSVNSNICFSNGVSRFSFGLFGLDSEEKDEPDDVVDLRFSTSFDLVVVVRVEVLSLVPSNPNSNSFSEGREGEAVGGGGGGGSGGDFDDTFSVKVDSVD

SEQ ID NO: 21521 - protein, 107 aa, Candida albicans
FSVLIARFFIFPSLPPHTHSYTKLTPPNENRFISNLSNRLDIFFLIIFHFINYNLIQLYIHIPIESYKTKLTLFNNVNCKYSFKPNSYRWWWISWSFCCSSGIFTWC

SEQ ID NO: 21522 - protein, 61 aa, Candida albicans
KPYLHFIKLSCSVVTCQKLTYFSTGSITVINYIIEPSIVFSESNYLLIIQEYNIHIQYINV

SEQ ID NO: 21523 - protein, 88 aa, Candida albicans
NSFLLLEDTKMGLALFDKLKKTKKKATRMISSFETFYQAAVSPSPPIPMSQNYAHLPNLYNCLSKFSFCTFPLNSPFCKACSFKTKLY

SEQ ID NO: 21524 - protein, 86 aa, Candida albicans
ISLLYKMHIINSLSLASYNRSPKIVKYKRNISGYLEQQDRKTVKNKKKLSDNYQGTRTASGYAVPKCKITQYRSSQKHVTGNLQSI

SEQ ID NO: 21525 - protein, 78 aa, Candida albicans
NYFVEKFMRKTHYISNSKLMQHALEKILDIKYIYTVDCSKHSITYLEFAPFPTNSTEPCPYPNNHTTSPRSRRPPYCR

SEQ ID NO: 21526 - protein, 67 aa, Candida albicans
QLNFEKLFNYYYYYYFLYYFQLFIYKSTMPRRVSNAPCIPVVATIDIGTTSARAIIFSSPTGAGRIR

SEQ ID NO: 21527 - protein, 115 aa, Candida albicans
QDYSIIIPGYISHIPFFPNFKKMEIHFSQLCNTGTDSIVHHIFECGENMELWLKHFNSQGTPQFIIGNTHLHKKDLYALNEYIKEVVQKVKRRRGSPILNQGERENVDAGTNVLV

SEQ ID NO: 21528 - protein, 73 aa, Candida albicans
QLKVDSLSIKLIVSTIGYKIKRLENIYYFKSCSLNSLAIKVSSKYPPLDKTQLPFYQMIRESLTSRILYYTSI

SEQ ID NO: 21529 - protein, 64 aa, Candida albicans
KWFMKLFNKQFIREFYLTQNCTDEPFSTYTSYSLLFGLTLTSIFHIFFSKDLKEQTFLHCGWCF

SEQ ID NO: 21530 - protein, 60 aa, Candida albicans
ISNCAKYANSQLSFPAWGFSRIIYVCAGGPPGLFSLESEIYPLTADSKLVSRFYACIGPG

SEQ ID NO: 21531 - protein, 68 aa, Candida albicans
SCYRVEKKSYGKLWHTVVPSLKAKHLPEYIIRDGKGGGRGEKKSLDIILPFIFFRSSGCSSSSVYCLV

SEQ ID NO: 21532 - protein, 65 aa, Candida albicans
LYTLSFSPLYITKTTRDKRSEFNVHVLVVLLINNIVNKLLLLGEKKNQTKQVKKTKRQKKMTKLH

SEQ ID NO: 21533 - protein, 65 aa, Candida albicans
NKEEKKKKETLIHTHKAYIKYLLTYTQHKRTENKKRKKKQNQTKNFNTRKLYFFFLFFLFFCFKL

SEQ ID NO: 21534 - protein, 80 aa, Candida albicans
NTVPTFVKNRMLSIIILCSVGTKSNYFRAYIVYSFKKSSHKMLIEIYFHTLACTPKGSSNTPHVPTLSCDHLKIKVYKDI

SEQ ID NO: 21535 - protein, 98 aa, Candida albicans
INTKWNRHILRIILSIFLQLNNKSIGNTIFESKKKKRREQGKLGRGFINFFFFSTNDTTKEEKEEEEELFRTVPIREREDSVASCVLLQMQSVKAKFD

SEQ ID NO: 21536 - protein, 88 aa, Candida albicans
QKNGKKIQREPKYCHFTPFFFFFFRFVRQLYFVVISDSGTNADGKEEKRADADADADSSFTVSRPQTFPPIQLLPSLAPSSSSSDSSA

SEQ ID NO: 21537 - protein, 66 aa, Candida albicans
KRKHAQPLWNPVAQSINDGNHNPNPDYASRFVNLPSSPGHRISRYGDPSMNGENIHPNGEVPGNIR

SEQ ID NO: 21538 - protein, 71 aa, Candida albicans
SPTPVGYLPRPTGVQDERSNAKFGNGNLNKVCLLESRHVSYRESKSANRPDYVSMATKAPSPTQATCSPEA

SEQ ID NO: 21539 - protein, 62 aa, Candida albicans
RKVIIVVPPSVKGLNDFNVKIRLDIAKYFVPNMITVQLCLFLCISNDHCKVNVFCGISFSFF

SEQ ID NO: 21540 - protein, 219 aa, Candida albicans
LQIIINHQSSLNTIYVYTYTYYTMSYSDHPPIIFFSIGNPGPITRHSVGHFMLKRLMESSSTTSIKQLSNYSSYSLSVDSFNNIIYIKSNTYMNESSKAWNKFKLSKEYRSFIKEQDQDQDQDHHDQIVSVIILYDDFENNLGTIKLKQFKKKSNNNESHNGLKNLKLSMIDGNSSNATGEAIYLLGIGIGPKPNNNPSGEIMRQWILSPFILTCRLDG

SEQ ID NO: 21541 - protein, 166 aa, Candida albicans
SKLPLYKSNMTSNNDDNVNLEKLNISDEIINDYDNGSQEQLDVLEAYQTDEDKQEQEQKEKEKDVELDNPDLEEEVGITMNDDKGDHKLNNQKIDDEINKEDEKDVKASDDDHDDDDDDDFDDFNEASFQQAPTIGSTNQENGHDDNDDDDDEFGDSSPGAEINLP

SEQ ID NO: 21542 - protein, 350 aa, Candida albicans
IDQNNLSPPPPPSSIHKYSFEKQTNQLLSNNKGRANKMNNLAIQEYFELALVFIQCVYHYIQQQQQQQQLELELEQQKKKDEDEQDSERTIAINSILDSISNRLFSMHFQSTIYQRIPLFVIYTVENNEGLPYDGTRLSPIISANSLTSTVTSTLSTASLPSRITSDEPPPVPTLPRLLLPSSPSTSDLALSDPLPLPLPLASASASVSPMLTSSPTSSPSPTSSPSPSSPPLPPPLPMQFPLPLPSPTPVQLQLPVITSPPPLLSPPPPLVMATGSSLPLRYEIIPLHNIDPSSSSDTESVTGVKELTELIKSRELLTFGPDGYGQSINDDILPPMNLFTPLVKFIPLD

SEQ ID NO: 21543 - protein, 118 aa, Candida albicans
TGVGDGRGNGNCIGSGGGSGGDDGDGDDVGDGDDVGDEVNIGETEAEAEAKGKGKGKGSDKAKSEVEGEDGNSNRGRVGTGGGSSDVILEGNDAVDSVDVTVEVSEFADIIGDNLVPS

SEQ ID NO: 21544 - protein, 65 aa, Candida albicans
LFWLLGYKFQQKRKERKIPRDDIYTSYICISIYIYTTTNLMLQNDQKNCGSRNLELEINKNLYVL

SEQ ID NO: 21545 - protein, 117 aa, Candida albicans
FFFTTRSKPRLHLISHFLQRVLYHHHNPYYNSCSLINQLLLVMTTSPPIQDDEQDEEFKLKQIIKEQNLIPQINSHNHDDVASEQQQQQFNQLSKDKKMNRLNKLIEKSQIYSSNYC

SEQ ID NO: 21546 - protein, 60 aa, Candida albicans
TLASNPVSASKYALKSSKQSESGTSTDIISPEWSKEMVSCIVEEKKKEKRMFQWQKNRHL

SEQ ID NO: 21547 - protein, 93 aa, Candida albicans
NILFSFFFSSTMQLTISLDHSGDIISVDVPDSLCLEDFKAYLLAETGLEASVQVLKFNGRELVGNATLSELQIHDNDLVFTHGPWKVPRIAAE

SEQ ID NO: 21548 - protein, 64 aa, Candida albicans
IYIYNWNLKLVVIEYKKEKAESKAEEREEKKNCLIKKKLIDYCDYRIEEQEKKKTRRSVLCVCE

SEQ ID NO: 21549 - protein, 82 aa, Candida albicans
  UNSURE (76): Identity of amino acid sequences at the above locations are unknown.
YLLHVMPKVGTVLGIGVDIVNSVRFERLLTAKSTSVGTMLSKRILHPENELPLCQQMHSQRQAQYLTGIWGSKRSXIQEHGT

SEQ ID NO: 21550 - protein, 64 aa, Candida albicans
KFNTLHVIHVTTTTTHEIRTHTHNNNYKQLSYLLSFFFFFILSFFLSLVFIHSNQSNFFTFINI

SEQ ID NO: 21551 - protein, 62 aa, Candida albicans
IFGGIFVEPFPDLNAIPYGMVIVGGNNEIISELAGEVEVDNEHYKQEYEDYCIGKIRATIDM

SEQ ID NO: 21552 - protein, 267 aa, Candida albicans
  UNSURE (10),(263): Identity of amino acid sequences at the above locations are unknown.
IISKSCINSXFQNLIYQYLTIMTSKVVIIGGSYAGLAALNTLKLLITKNSGAIAKSISITLIEPKSGFLNILGLPKSIVNKEFASQQYVPFCNFLKFDNVVSNSNDLKVQLKENTNSDNNNLMLNYIQGKVTKLTSSRVTYTTNDTDESSIDYDYAILATGRNRNWPVNPKGITFESYLNEMEITNKKIQKSSIISIIGGGAVGIELAAEIKLHYPNKVVNLIHPHGTLPPEPILDAFKNKTLQSLKQANINVCLNTRLDTSXTSTK

SEQ ID NO: 21553 - protein, 234 aa, Candida albicans
  UNSURE (234): Identity of amino acid sequences at the above locations are unknown.
TSGMKLEEEFARIARKAETSMKTIDSHDSEMNEKFQNSQFLKLMSSIGNRQVELEGDKLVTSDSKEDIREKGIPETITATNPTITTAPRDTQEGQFTLQGPSNPDFAREMYDQIPRPKPANTAFPHPLSGDSEHEQQQEPNDPHQNTLPDPLAHIQDGQLSDINDPLTAARIISGGQVQMSDWVEDYDTISDTPSKLETDSNNNPNVRPFRKGQIVDHHWDEMYRDYRHDDDYX

SEQ ID NO: 21554 - protein, 225 aa, Candida albicans
THTQHLRMPPKSLKLIKKGLNPPVQDNKTFNSLFKEALNSPEHFLCDNLSNFKLPSDIDFFIGFIETKQFETWLDIISRQNNWTRNKRVVSSIANNNNEQIPCNSKKLAYLEELYYNCCLLGKYESKMQKGPGARYKNAVPTTIRTGCPAKWYAKKPKSMPNHWLVGVIPKHNHKNLLKGGLNRSARLWLKQKVEDGHNHNYIKKLLIDLHAVFYHRSGRIRVLR

SEQ ID NO: 21555 - protein, 79 aa, Candida albicans
QYIYGSHKNGQLYPEESYTNEQTQLLRIVDWVFHGLCSNCQKILKLFFTTDVADLVQKLILAILHYLFLTKKIPSKIYA

SEQ ID NO: 21556 - protein, 69 aa, Candida albicans
KKKVNKQQKRPNENDDEDEGEGQRTSGILIFWDIYIYEQISNIYKREVVIEIEIEICVENILKREGNQF

SEQ ID NO: 21557 - protein, 71 aa, Candida albicans
  UNSURE (47): Identity of amino acid sequences at the above locations are unknown.
KHLVSHSQPLPFSSFLKHITKKVSIKCGNFQYIRKLILQMLCSIIRXRFHLIPIGKIYLIFVMVDLNKRIG

SEQ ID NO: 21558 - protein, 79 aa, Candida albicans
SHKLQKITALSGYFFMVDFKTISFWVMTIILSVVFNAIAIYGYRNNVFNKTLQSGIYNQKLFLVWFLSDVRKYKEYYEI

SEQ ID NO: 21559 - protein, 63 aa, Candida albicans
FEMMSLFKKAQVRVKDIYCDLNVVFHSPTHSSKIQPEKKFYHEIPSVLDSRLLHHGLEGPALI

SEQ ID NO: 21560 - protein, 61 aa, Candida albicans
TVGWTVKHHIQVTVYILNSYLCLLEQTHHFKSKSVVYYISLLPSIFGFQENVVSFEFFCKC

SEQ ID NO: 21561 - protein, 71 aa, Candida albicans
QNFSIKYFIKIIENKKYEIISSELMLRDVNVITENPLYYSWITPPLSPAQTPQHTIIAITYKLCLYSILSR

SEQ ID NO: 21562 - protein, 61 aa, Candida albicans
RLGEDFERQPFRFGCIVFNDSNLDNESKNENVDCLEQTQNYPINNFEEKQSEIVNKDPLVF

SEQ ID NO: 21563 - protein, 67 aa, Candida albicans
VNSKQYETNKLAKMESMKQKLINEKEELDLDDIFSKLNLARDHAQSLTQDERDKYANKVIEEIIDFL

SEQ ID NO: 21564 - protein, 137 aa, Candida albicans
LITIKFIFSYLFKVIMSSTIPSEDKKPLLDSEMEPEVSVNNNEELPPYSDNEKHLLLSDNEKCDLEEVPTSYRVTRHSNKFKRFCQILSLFGVLYLVNFLYINRDDFARGMSTHFRFNCGSLVWHPLFTSGQTIRAI

SEQ ID NO: 21565 - protein, 73 aa, Candida albicans
TVSWFRIVKVSSEAEDATVDGVDSPLVFEFLATPMLKESNFKSICFNSWSSSKSKSKSGDLTRGWPDPRLSEE

SEQ ID NO: 21566 - protein, 214 aa, Candida albicans
SSLKRGSGQPRVRSPDFDFDFDDDHELKQIDLKFDSLSIGVAKNSKTSGESTPSTVASSASLETLTILNHDTVYWAVNATLEKLKLSALTDLDGKFGRLLEIPTIKTNVSAICDYYGNNKLITDVKVEKILVDYNRYKLYTLIGSIYLIREFVLAPIKVIKSKVNKDLTKFDSNLSPDPNAAHKTTSILDFLHLDVKLDYLDMILCLSKDFKVR

SEQ ID NO: 21567 - protein, 76 aa, Candida albicans
  UNSURE (1),(20),(21),(32),(45),(47),(52): Identity of amino acid sequences at the above locations are unknown.
XKRPKYFRKTKGFNLIIIIXXFLRSKDDASEXFRLDCLGILFATXPXNITPXVFHGGTKINASFVRHKKIFMLAGC

SEQ ID NO: 21568 - protein, 83 aa, Candida albicans
NLHFVKQTKKNYEEQLNSQRQFVLFLSVCKLVTFFYNQWFQFFSYNYTRPKLFDENRNPLMEYVSIQVEIIQIIVCLNIITQV

SEQ ID NO: 21569 - protein, 67 aa, Candida albicans
VNNLSLFSIHYIVLRQILLELDPLHSCCCCCCCCCLTGYFIFSAPWLVSIIDELLRQSTTIHVNLVR

SEQ ID NO: 21570 - protein, 63 aa, Candida albicans
RKIQITQTQSTKHEINGISCHVISFRLNLKINMRICDISPYYDYDPFKYDHSIQEVTNLQSFM

SEQ ID NO: 21571 - protein, 61 aa, Candida albicans
IPSQQLENWLTMLIKHSVRFRVNGRGLIISNKSKGGDDDEGGEEGGEGGEDEKQKQIKRGN

SEQ ID NO: 21572 - protein, 67 aa, Candida albicans
KEILLDRFIDLNCSGFVDGLSKKINTKYLYMNMRILDKKVRCYFISNYRLIRLERNVLKTKKQKKRG

SEQ ID NO: 21573 - protein, 91 aa, Candida albicans
YLKMSSTKYTTHEPIPDETETQYIPYIHDSTTANFDFPTSFNFLYTNDSPDIRYYLYKFTTDHLNCPICSQPFLSLLTLFVAIPFVKKAFF

SEQ ID NO: 21574 - protein, 63 aa, Candida albicans
NVEIPIRLSTDHFQEHRFVGGQPITMRINVSKLGNKIWEVGNKYNEIGYNLKRILIPRDNKPS

SEQ ID NO: 21575 - protein, 236 aa, Candida albicans
  UNSURE (179),(193),(214): Identity of amino acid sequences at the above locations are unknown.
HSYIYESLIMVATRRSSGKFIDVELSDNGKELQEVIPIEEQRAAIARASQESEEDEIQETSPVLVEPPPPTKKKETRGRKRKNPNANSTSSDSSASSSSASSSSSSSSSFDPVKKIERRGRKRKNPDVSVPTTIKRTSVQNNLVRSTDKQTPTDTSIATNVVPNKHKINHLLTDDAPLXPPPQVQNSISSATXTSNSLKYSTANPQSIPNVMQXTVTTPQRPVLPTSGLFQQKQQQ

SEQ ID NO: 21576 - protein, 60 aa, Candida albicans
  UNSURE (25): Identity of amino acid sequences at the above locations are unknown.
YSPWIFGGDGGGNGGSDFPIVGLLXVEYNGFLLSQVNVSGIMSIFVFVSLSLLGVIYVSM

SEQ ID NO: 21577 - protein, 77 aa, Candida albicans
WWDDSLCSCFISSIPRSHLLVDCISVIGETYLPRVFLLVFGLKLGLNIWALKATPKGIPWITTRTYSSLWFSNPSLQ

SEQ ID NO: 21578 - protein, 115 aa, Candida albicans
  UNSURE (78): Identity of amino acid sequences at the above locations are unknown.
DLGILEMKQEQSESSHHYHREHDIFYHDYYTQLRNVVERRYYIDTYITPRRDKETNTNIDIIPDTLTCDNKNPLYSTXNKPTMGKSLPPLPPPSPPKIHGEYYRTNRFGERSHYV

SEQ ID NO: 21579 - protein, 183 aa, Candida albicans
SYEKKFGNTKTENIWHASQLNLKSEVSESSQVEKKASGDIRVPNAPNESRGSGASSRNNSSTSFPPPPLTITTHGFPLFYYVPADNVNFDNSYWANPHPFYNVYPQYYPATAAAAAAAAASATGGDNGNLQYDTPGCPPYGVANVVDGSPEFSMIASHPSYGGIANYMYYPNEPEMNINDKKV

SEQ ID NO: 21580 - protein, 93 aa, Candida albicans
  UNSURE (5): Identity of amino acid sequences at the above locations are unknown.
LFRPXTMPVRLLRVNIPALSDQHVSTESEKEYETTVWGTRIPKNEAVSSQSAIEDDDWEAEEMIRKAKEEMSRQEQAGGGKKKKKKKLVLLSS

SEQ ID NO: 21581 - protein, 134 aa, Candida albicans
ITERHTSGMFKKLESFTNPQHSDIRNTPKQDPQPSSPASFVTGNGTDVKQATDQHEYKNPFPTISAVNSASANTLPLRPSFSHQPPIKKPRLESLHLRNTSPFSLNHNINNNNMNPQLLARPITKPREPLEVIF

SEQ ID NO: 21582 - protein, 97 aa, Candida albicans
PPTQQMSFKPVEISGKFGFGTMSMTWTPTPPPAQQSIDTLKFVTSHPKFGTKLINGGEFYGPDFANLKLLKQFLEENDPEENIQLCLTGRIEGQRSD

SEQ ID NO: 21583 - protein, 131 aa, Candida albicans
AIMFKGLHLLTPIVTTGAIIAIPTSNQMIFNESTRKRSFYEDDENVVPIPGTVTPAPATELETLGSNRIIDGISVRSTQSTENLFKSVRKFTESTVDSLNSWADQKYHQYNKTERWVTEYVSSLHSKSEDL

SEQ ID NO: 21584 - protein, 115 aa, Candida albicans
LFFFVVVSHLVGWSGWSLSCLFFFLFLLSHYFLFAVKVKFLVLRHKSGNRKEVKKKRLLISKLFLISYYFNNHNTYTMYRRSLILRHSNLPSRCINIIRNYSNSQPSDNKYKDYD

SEQ ID NO: 21585 - protein, 61 aa, Candida albicans
DLFCVCMEIYILFVNQYCFQTAIEKNKKESITLFRKYIIGYGHLSKKKKKKQQQQTIYFFN

SEQ ID NO: 21586 - protein, 227 aa, Candida albicans
KHGSKSFTLEDILLIYTTNKMNYLIGGEGISIISQKRYLQYWYDYIHNKQLRESYINWLNIMKFINLKIIRIGGLKLSNIDYLNISILTYITKIETDTSGNSNNRSNTIVKELIQLTNENCDIDNHDDGHDDYWITYNIHDLKIFQLEDIMIGIQSWSYIWFNIFFESFKSNGHGHGHHNNNKVLFNWDDDIDGFKGFKQKGIKLFNEIELQWDVIITTKSTDIYAN

SEQ ID NO: 21587 - protein, 148 aa, Candida albicans
INGNNEWDSSSSSSSSSASTLLEFINIDDLDKRLNHEINNYKPQPIQPIQQQQQASHTQPSNISTLLFNRLVKLYGDKNVKFGNGNNSTTSTKQSEIIIFNEIKIIKPFTNIKSNIQIIKENGKKHLDSIQRALNQFWLEIDNEKRGG

SEQ ID NO: 21588 - protein, 66 aa, Candida albicans
MPDLKAIKILNHKQTPTGSFLQMLFEEGHSAWLALHIAMEVAPDLTLHYLYLYPDLQKYHAEHNPD

SEQ ID NO: 21589 - protein, 62 aa, Candida albicans
FKFYSEQIFKTEGEEEEKKRGGRKIRRDTTDKTFSETSFYHRYHHEDENKPFFMVHAICYKL

SEQ ID NO: 21590 - protein, 80 aa, Candida albicans
EHIISTQSIPLVTPYDYHDDDVDKKYRSKGYFEMFYSLRTLIISIVIGIITLFTIYTQISNSKSGYAPNLSTFDTSQVQF

SEQ ID NO: 21591 - protein, 65 aa, Candida albicans
GNSVRKQIVSRVGYGLDSTLFMENVCVSLILLSLLLLLDMARSIIDEVIPHIPFDPGSQGSNHFN

SEQ ID NO: 21592 - protein, 61 aa, Candida albicans
FLNKDKDKDKIKYLMLYVTRNKLTNAPPLPEKYYKKINKTHNVRKESLIKSNKRTKYQIIQ

SEQ ID NO: 21593 - protein, 79 aa, Candida albicans
FPSLPSLKMSTTKPTTSHVESDTKPDADHLEIRKSNLSESDLGVEEISDLKYINLPPLLQHMTQEELRTLDKKTPESSI

SEQ ID NO: 21594 - protein, 87 aa, Candida albicans
ESEDNKLINDNFMIREDMNVQRMMINSLRKQLQFLLFSKNRNTTLTGGVGGANNMFPSMFPTEELGLGEIYETVSRSNSEERLNLKL

SEQ ID NO: 21595 - protein, 123 aa, Candida albicans
IRELIGMVVISSIYTGYLTPVTCIIEIGENNNEVGYSTKTENRIIVEFKIMNKYREDAEDDDGCENYSINFNKRLERLHIFSAFGLFVCCQLCMFVFSHARSRHLVQHLITVPHLKLLKPIQH

SEQ ID NO: 21596 - protein, 181 aa, Candida albicans
PFLILNLTNLINQILLLLILLTMNSNIEDDPWSSGWNDDNDNNNNNNTSINDPLTGATATTTPYQSSYLTSSQLFTSTGGGGSGSGGGYNSGVNTYNTTIPPNLINVPSSYETIYSHFITKYNNNNNNNNSNSTFTLNDFAINITDTLISLNYLTNYQKQHILDIIYAHNLHHGAGRIRTP

SEQ ID NO: 21597 - protein, 215 aa, Candida albicans
ILRPNFFCSVSIKSEGATCPFSHITTLMNENEESTKLQEVGSNVILPPIVSYGNGENGASSNGPSLSNQKRRKCPFDHTAMMKRKSVYNNPIESNMREYRSYTPSPLGSSMPITTPMMRHQQEDEEMLKPVPLCSPPSNHQQIDSAASTTSSPSMFVLDDLDVFNEFNDFDLDFLHNEHLLNHIENNNNNNNNSVAVKNSADNNESRNIENYFQG

SEQ ID NO: 21598 - protein, 88 aa, Candida albicans
  UNSURE (24),(50): Identity of amino acid sequences at the above locations are unknown.
LHSLNLIFSSLRMIRLVRLGPGSXILRRQIGYIPNRGFPIFRNVKPPLEXRIPTVSYKSNKLYSTSTVSSTINSSPKKKKSSSSSSSR

SEQ ID NO: 21599 - protein, 398 aa, Candida albicans
KHREFCFILPHFALIHLLTFSNLIIPSFPSIHHSNSQIFDFYFILFHFHFHFQFNFYYFSRFFFYIMSENITSTTSATAANTNTNTNTNTNTPTSTTTTTTTTATHSKSNYYNPSLIHHSIYNNNNNNGTAGSTGPIKTIAAATSTSAAPTTNTDSGKSSVSSISASNSIFSEAPEVNSHHYYSHPPHQHFPFMTNNNHHHHSNVNVGGIPTSGYPFPQLNASPTTTIAGTITSHSNGTPESQQQQPLVAPPPQSQPTVSASLPQFQNQIVSGTGASTNPPLNPRISAKFTNNDIQILRQLLLAGEKHKWKQITKELNSSTNHNAHIVAAISAAAIKSRSLVNNYDSNNNINDNTPTTNLHHSFGYHHLQQQQHSLEQKSLGHRVGNGSSPRPARTAL

SEQ ID NO: 21600 - protein, 72 aa, Candida albicans
RDNDFISIKGVLPINDSMPRVRGGNNVSLEFDLSLLVVVTYKLYNSLAIRNNDITDAEVCNVDFQLIAILIN

SEQ ID NO: 21601 - protein, 104 aa, Candida albicans
IHVTQDMTLHEQVEELQNLFDENESLIENNCARLNQLQQELSQEEVSFLEVKDKLIKLLQQLKVSYGSTQPYTTYLQEIADAASALNVTNDFNLQLANVLKSFQ

SEQ ID NO: 21602 - protein, 61 aa, Candida albicans
LAIQVGPSTADEDIEERTKYGNHTPKQMYNKLKNSKRKNSSLYNSNNSNTHFLQQFGYQML

SEQ ID NO: 21603 - protein, 95 aa, Candida albicans
  UNSURE (82),(87),(88),(91): Identity of amino acid sequences at the above locations are unknown.
KMIVSHCHGWKFPVTTPSSVKLNVKVNGKEFRMMNLNIGQETDHKVSRTDFSWLKTVRIVRNSLQEKILDSKSTFNWGDTNXLEIPXXAGXRIFR

SEQ ID NO: 21604 - protein, 88 aa, Candida albicans
PLKCESISITWLLSIDSPIMFNSFFCNKNLQIGKNTLDSNGNAIALTKKIENPYSVIVSNNVFKGENDKYWIFKTGKSHKIFTTELAG

SEQ ID NO: 21605 - protein, 168 aa, Candida albicans
LLFQHWQESVSSLEYGWTNLDYIIAHRESFKKSRNIMKYEPVVKGVYLSNYIVNSEETNHLGMMRQFVKTSNYYNQLKKLYNEFTEMRQKFLINLPKCHFNCSNHSKILSNYDTKINDYNLEMKKYKNYLIILGFGLQLRFDLEEQDRQQQYDTSLENEDVDDDDECE

SEQ ID NO: 21606 - protein, 78 aa, Candida albicans
DYETIGETLSTTDIASSAGAKSNDTSYQDDELTKLVKFEIKKLFFNMKDISKVIPTFRSLKSIKNLADLAQDIDNNFG

SEQ ID NO: 21607 - protein, 86 aa, Candida albicans
  UNSURE (11): Identity of amino acid sequences at the above locations are unknown.
ANYNDNESPIXQLLATTNANPTVKSSSLIMELSIAEEPEDAEDSDTTRRSSKVNNSKDHSPATSISSSIKKPNLKIANSEVSALVI

SEQ ID NO: 21608 - protein, 69 aa, Candida albicans
ISTRHFEYRLLILLSHSNTGACVSDSGASRQPPGWAQHPPNPGVGSSSHIFSRPLPTIGFTPFLRPLHH

SEQ ID NO: 21609 - protein, 106 aa, Candida albicans
FLIMTSPEAESTDPSKSNNDNNREIVLRSHSDSTINPNPTLHTPTETQQQSRLYGTFFFWNSLTTHIEERTELSIEQASAETPQLQPPESTTRASIKRVATRIGNY

SEQ ID NO: 21610 - protein, 211 aa, Candida albicans
KNELNCQLNKHQLRHHSYSHQNLQPEQVSNESPQELEITNNQQQLDGTTTWWNFSSYSMISYFKTTQNTLDEETPLLMPPSTSQTTSTKEDSDQTVTQTSSWWNWVFGSTTPADNSEDDEDESHTSNLELYKRAKQAIETSKEEIHYVFKKSISLDTDISNKVGLSVYGTLTEETPVEYNCSKRKNPLSPNEILENLTTTLHHGARRSRTC

SEQ ID NO: 21611 - protein, 83 aa, Candida albicans
QNEIIMWLASVYYCYIYSRYSPIYVYICYNVSNFDSLSNQIHKTSIAFSDPGKSPMIFCYTETENFSGKKKTDIGNELGKSIN

SEQ ID NO: 21612 - protein, 61 aa, Candida albicans
IVFGVCISKKILYVIFTIIEFTSPQVSVQEISSVNKTYSLISLSSCKDLKLLKTTFIYKKN

SEQ ID NO: 21613 - protein, 290 aa, Candida albicans
PRTYIFQPPGRILNSLSAPPAIYMNKAASVSSFGCLPTTNTTKTSGVSSSKCSPKLNGTNGSTPYDSAYDLLNTFDVPPPLPIKDGIQNKLSRNSSISSKGSSRKKGGLRSRLSSIFSSKSSSSSVSSKLADSTPATSVHSSRKPSIGSSSNTLVNSKTESQGSNYATTTTTTTSDAHSHSTRQSVPLFSAQPSTPSIHHIPPIIKKVESSGVASSAATSTTRKPASVYGHRYGSVNDLTSVYSTDTTTSGFSMFKRRDKNDVKFVPPLTRNTRKGNKYNVKKVPYDIWA

SEQ ID NO: 21614 - protein, 64 aa, Candida albicans
IPSLIGNGGGTSNVFNKSYAESYGVDPLVPLSFGEHLEEDTPEVLVVFVVGRQPKLETEAALFI

SEQ ID NO: 21615 - protein, 223 aa, Candida albicans
VCLIKSFLLVFIIYLFHLFTHSLIHSHLNNIYIYYSNMAIKDRVKRVSKIFTSDSKESLKKEEQQAKDTKEIEPSTTTEDAAAAAAEVKASTEGEATKDATATATATEGEVAPTATETKAEAEAEAEAEPVVVAAAAEATPKEVATEEQPSPSADITEEVAEPTADKKGGETETEGAATATEAKDAKAEIKDSAEKTEKAVKKNEFFKKFISKFKKNSHAAKN

SEQ ID NO: 21616 - protein, 91 aa, Candida albicans
TLLILHSSKKRYKMNLPLKFTIVFTIIIQFITAALLSFLLLGCIDTSSNYSNVYLLSYKFNQSSPLYDYLSTSSNSSITTTTNNNSTAIDA

SEQ ID NO: 21617 - protein, 69 aa, Candida albicans
IINHSTGSHRDIKTLKVNYHFWKKVNDHIIKDYLKHELILLLMTLYSLLLRLKMVTVENGLELILGRTC

SEQ ID NO: 21618 - protein, 61 aa, Candida albicans
ASIVLIYFYSFLKCIKREYLQEVGGKSMMGKSTEKNNIFRERDPPNTVDQIEQLFWRIAKN

SEQ ID NO: 21619 - protein, 68 aa, Candida albicans
YQMLRKKKETISPFCKNIVLVGEYSFKQMRFQQVLPSINSRPFSTVTILSLSSNEYNVIRRRISSCLR

SEQ ID NO: 21620 - protein, 68 aa, Candida albicans
LLIERELEKKEEEYTSLFILFCPYLLVCFNFGDLHRKPHTRLLQVFSDNKKKNPGAYAEETQTFFNTI

SEQ ID NO: 21621 - protein, 84 aa, Candida albicans
KLCIPETHHKKIRKYQAMKISSSLILLINKPTRNIPLKFVSQNNQLDNIAKNCSHSGSFYADDFLGVYLITLLPYIFSSRIILF

SEQ ID NO: 21622 - protein, 86 aa, Candida albicans
SLVQAANKQKNHSILHIPNLNQSQFIITSYLYLFILQNVSLLPLFFFSSTCSTASPHTTQYTSSSSSSSGVVVAAPAAATTTTTIS

SEQ ID NO: 21623 - protein, 70 aa, Candida albicans
LISTLQQHTITRKEKEKEEKKNHSKKIIHSLNHSTCIHNILLDTFIKRNKQFYILIDSLFNFFLFNSRKN

SEQ ID NO: 21624 - protein, 409 aa, Candida albicans
SRKMDHSKVPVFKRRTKLPTREELAAIFNPPKQRKLSSDSTPRIIEQSRVSLDLPLLTQTHQTQHSTTSSTKFISPPHLLPPNAAINNPILNSVPQNIIPIVHLPAIVSDFFSDITTDLTNEKLSNQINGILGKFPPPIPPENPTTTTITTTTTSNPPQTNTFEDFTLERGGMMFPFIYPPPPIINPNELPYSLASFKEKLDNLYYEQQQQLQQSQIKPFRGRLQAKKKLKTPDSSMTIKSPLSDITYNNTNDNQVYVEAPPLPFPPPNYMPYPLSSEKSTLTPSEVFGVFLEANSQLPRVDMVVASAAGSLFDMKSLAYKEGFNILDYELGKLNGNNNNNNNNNMSGGNRGKLRQRTGLKGMDEEGTINDNETDDGQNREEQIIEEEEEREGEDEDFHNGAGRIRDCY

SEQ ID NO: 21625 - protein, 102 aa, Candida albicans
RSEPAKRKLKKRKSHPRAKREDDDEVQKQQHQKLKEEKRKKKGEKTTKKEKTQPPTSKKKTRSNSESATKGEPDNQSSSSSTTIAAQSPLEVYSNTPEWKVR

SEQ ID NO: 21626 - protein, 252 aa, Candida albicans
  UNSURE (4): Identity of amino acid sequences at the above locations are unknown.
NIKXTAVRVNLTLKNNLIKLFDYLNTWHINNTLKDHQHSNPKYQVDKVSTIGDSHGVYFHWDDWVDLSLGNKKLDKVRQRNSKGQDHLDDDEDEDQLEVDDNECDASLLHYANVNAHRLESLETKHIRGRCQLYCLFPIPQRIIATTDNLFIEIPVIGKKRLGIQVSTTNNDKKFTTTTKLVSTMENLQNNFRQHYHNHNQQNLHTSEEPQLLIRNITRLQPKIDNLSVKDFVFNIDSEIEKLQIAILTPRR

SEQ ID NO: 21627 - protein, 380 aa, Candida albicans
  UNSURE (376): Identity of amino acid sequences at the above locations are unknown.
TRTFLPVVKTKNKTVSSDKPPLQTLKSSKLLYDKSKEYQPLKPIPVTDFQWDQIEPIKSYPFKNAEYKLTMGIRTLDPQDWLLIEPTYKSRIETKSKILNNNHPDYPSTKDLRSSTLFSTPEAILAIKEFYGIVMNYMCDKYPTCFKIQEDENLIYNLITNKKYPIPNSIDDVEFDSYQLQEFLAENIEEDFIILLKDPTRESEENGGNEYFFKAGVFAFAAGFNPIDRFNTPLSFIHHPIPGYESKLKISMNRFFNRLSPGQFVTRLNFSIQTHNKFYVDDSNKGYHNPKGGDVLELLKFEDLDFENQVHYRSERQVLTKLPKSGAIVFTIRTYLLPLAQIKSEGKEVCDRLIGAIKGFPKDIAHYKRSDESGAXSLRR

SEQ ID NO: 21628 - protein, 71 aa, Candida albicans
TTASRSRYAILNGLEESLITGLETVGSKGRLKFLYFRFILANSSCQFSGVLFLNSWEDACKFLNNTELIHR

SEQ ID NO: 21629 - protein, 283 aa, Candida albicans
INSVLLRNLHASSQLFKNRTPENWHEELAKIKRKYKNFSLPFEPTVSNPVIKLSSSPFNIAYLEREAVVYKFMLKEFDEKCKEFEEIKGVNTLYPDLVDIIIKDIKETFAKDHKELAELTTDEILQTVRIYYELLNQHLYLDELEFNKPEVQKLFETYNKLDNTEEPDYNKIANDLGLNPQAVKLWIEIFQTLESVDFAVDGRKSFPLCPPEYNLLINLKQVRENIEKITPKARQDPFGMFFNKANPKQDDKDSSKNKSNEDTKDKKKIVDILIELTPKNIFM

SEQ ID NO: 21630 - protein, 158 aa, Candida albicans
RASSKQYLIYQLDRFEKYLTKDRVANDDIAKIAIKLTNGNRVTGYFPSNNSIEDIFIFVELINRGYLNVANNSTTTTTTTTTTKLTSTLTESQALTKFKDFKLIYNFKLLSPLPPKICLNDVLLSSKDTTPTATTIKINQFDIIYPNGLLIVEDIQKD

SEQ ID NO: 21631 - protein, 159 aa, Candida albicans
SLPTRISTRGQGNISNSKKISPSLSSITTTTTAEDESINDLPTNVITPTPKTTTTTTTTTTTTINNDSKYPLLIRLSMNSSDNKIKTKTKTKTDNKVQKKKERVKISTVVELDQLNEFWDQYIQILKSGFIGLKKKKDYKKSHTNNNSNSNVNNKIKKK

SEQ ID NO: 21632 - protein, 157 aa, Candida albicans
EKKRAGVLYQSKTKNTEKEEKTKVDRHKIHKTKPSRKRRQSKKTEKESEKKKSEEKENQENQELKNQRIPKKNEKGKEAPKKKTKDKEESRNTINQNGKREKQKKKQKSKKQRANPKGKKEEKIKPEKERKEFSGKNSKEREKANRGSKKNPANLIR

SEQ ID NO: 21633 - protein, 67 aa, Candida albicans
YLVILAVFVHMCECVYMCVNSGHILVPEKIFKQIRNFASPHYFLDVPETVYSFDTALSMCSPAEAIK

SEQ ID NO: 21634 - protein, 64 aa, Candida albicans
FSCYSVSFILLFYKSPSLSSITFTLQLGYNYRSLNISFLILLIPASLKNVSAPRSNSASVLPTV

SEQ ID NO: 21635 - protein, 135 aa, Candida albicans
KMYQHQDQTQHQYYQQYNSYNPSIEDLIASSDDKRYQNGGIGNLLQRPPVAGLPYISSQVNPNTSSANLSKLTSNINNYGYNNNNNSHIQLHTPPLSSNPSFTSFQNLNYPLSPLSKPTSPEPILSAASVTTSNF

SEQ ID NO: 21636 - protein, 115 aa, Candida albicans
MLSFNRNIQCHCFQIPPPPPPPPQPPPPPPQPPPPPPLLLPQPPPPPPLLLPPQLTQPPVLPQPLPQPLPPMHFPPHLPHELVELAIEQHNVLEYNSEFAESTGAPGAITNIEEL

SEQ ID NO: 21637 - protein, 62 aa, Candida albicans
NTNNHKETTLNGLTSQPTLPSPKFYSTNEHQYQVILGLTLLIIKILKCTIIVEYLFSSPTIM

SEQ ID NO: 21638 - protein, 65 aa, Candida albicans
LFFLKESFIIYFSSYIIHHLDLHRTRKIFVSEKLRSCTRLNDNTTIEQNDLRLTKSVCGQGNERI

SEQ ID NO: 21639 - protein, 79 aa, Candida albicans
HKIKKSSTAVKHIFNHMAKYITHCTFFHCSSFFFSKSITSSSSWDLINLFHTQQQQQAQGLAGALKGSAVQNRLWLIKL

SEQ ID NO: 21640 - protein, 60 aa, Candida albicans
ENRRIAYFLVLNVVHVQMVIRLLIIDWSLRIATTTPLENNPYLSLYVLNVFCYEYIQSIA

SEQ ID NO: 21641 - protein, 63 aa, Candida albicans
CHYMCPQHIVSKFPNWGWGLLLMHMERAREMTAGDNIKTFKLGLTNNNNNSSSNNKVFHMHSH

SEQ ID NO: 21642 - protein, 93 aa, Candida albicans
IPVIWNDGSTRNGTRRQAKKNRSWDPGGISLLKVETANAHTQIEIAKVVLNVATTKVEQNDGKKIALKPIYIHTKLVENNNKTNLILHYSILG

SEQ ID NO: 21643 - protein, 204 aa, Candida albicans
TRVLHPVVKNSLAQLNLQDSNGALGRHISDYTKYLFDDDEEEEDDSGSEEGNNRTVHLLAYGDNDRTLISAKGREADGYRHDTNPQLPTPNTDDGLSRQGTSASEASIQSGGSLKFTVADSKRRLNLPLKPVTNNKPKKKTKNAKKSKNTLEIQPPVCQEYNPNMPLPELSMGMMPFASSMAGLAPPPPPVFDGSPSVKPMMMN

SEQ ID NO: 21644 - protein, 245 aa, Candida albicans
ISTNTLNRFLPYTVHFEIDTAEVQSIPQDTATSAQSTSTPSTTASSTQLSILPSLSKQPRPAAAIPDNKQFERSDTPEGFFYNKRNSAKSEHQFIQPISKISKMESSVVDSKKPNEGMGLPGFSRSQVNLANSTPNLARVAKPLAPPPLNRGRSSFSKALFTFHGNSSATSLLSEDGTADSSPVILPSSLEDDFDQNFHDMVHGKSRLAPFGGFSRPGVESQFLSEKNIFDVAPWSSPAGRKDSD

SEQ ID NO: 21645 - protein, 104 aa, Candida albicans
IIVVKMNSVKKIRDGLEDYDEEIYRQLHTDKLLDKYNGNKYEDEEEELMMALALSESMNNSRDASEISINESLLTPDDKSQLEEDEQEMDEELRRALELSLIEH

SEQ ID NO: 21646 - protein, 179 aa, Candida albicans
RPIGSFKGDPKIINDSFTQLLNHGPKTNDFNIWLKLLDKPKLGNKESSRDLKLKLMILQTFLKLFQANYNFNNYIDYNEFYEKCYQLYLNGGNINQISIILQIFYYIAKKSKSASPTSLTTKINQQFTRFLKAKYLCKLRLDEIFLQIILDKNGDLQRYEQIEWNNLNASDITFIRESL

SEQ ID NO: 21647 - protein, 68 aa, Candida albicans
PVYHGNGFRELVTRFNVVTGFHFFSSSTLIFWGKYQFALTFIITFECARYFLEIIIYFHISIFIYVYL

SEQ ID NO: 21648 - protein, 84 aa, Candida albicans
LIFFFTLSTTTSTFLMPSNLFSNYFYRQRQLPQHQQNDINTSILEPTTAGTVDANPNPVISNLINQERPKHNYHKSSDNLAIGL

SEQ ID NO: 21649 - protein, 332 aa, Candida albicans
RQCAQMPNGQNQPSMEQQQRMAMMMKQQAMAAQRQQIPMNGLDPQQQQQMMNAVGGGPGNLNLQQQLFLQQQQQQQQQPKTTFQQQAQNQMNNLRQQAAMVAQQQQQQQQQQQQQGQLQGNLASAMGDSSLKNNSPVGARSNQQLTPQQNAAPAPLPHPSQQGQAQAQHNFQSQQQQQQQQMTKMAGSQGMKKNGQMSNGTSNNSSGRNNNALRDYQNQLMLLERQNKERLEFARNTGNSDSNPLSNGMMFAGQNQYSNSNQNQNQLPPNQQQPTPATFHPPPPPTTANGPQGQFNQKPSPATSNNSPALGNKSSPAMGNKKSKKESNSKKG

SEQ ID NO: 21650 - protein, 266 aa, Candida albicans
  UNSURE (4),(5): Identity of amino acid sequences at the above locations are unknown.
NLKXXMGYPPNFKIVTKSLTENILLASTAFSRVDKFNFGARMAVFKFPQSNKIILWSPLPYTPQVIDVLTKFTNNTNESNLNIAYVIIPDREHNLAAKSYKEKFPGCKLIGMEGLDENSLKLDYKFIKLMGNKVLKNDDLRQIFNDNDSGLIVDNFEFVYLPNHANQELVVFDKSSSTLFEADLLFNLGVPGSTLGETILEQYSPELGFPKGFNPHSGWSFITRYLQPYSKVGRFLFRKIVDINHSKRALEAIFFTHRPGPSALGR

SEQ ID NO: 21651 - protein, 142 aa, Candida albicans
LDIECHKQSLVTSYGKPIIPALLNKNILNILCVKKIHSNTFGHINIEFTNSILNNIPIHPIGSLYGLLKPGLVFNFQLLNLSKCVPILLNSLSLSTFKDISLVIFYLRKVYPPNSLNSLPVNNKSLLLCSYWVNTKGLYIVI

SEQ ID NO: 21652 - protein, 306 aa, Candida albicans
FVDLRARVKTLLVPVKKIPKLTKQIDDRSLTPTQYSSGSIVSLSQQQKKPISILSPRSTNIPDCSCMNRQQCERCQNEKSTDKEIVEDSQENPEEIISINNLFPSSTSLTSSSSSTLLPPFHIEIPEGYNTIILQRKYRLQFYINKYYNDPNFKINLRLHPTKLIDWDEVDFIINENYKPDKFTQFLNRNNIKNGRQFEKFKKLYHIDNNNNNQQQLSHLDQFEFEDKLSQIFDKFQSPPGFMQSDFPDTQEYKQRREIIKQRQLKRIERRIKDCTTIQDGKQIGEFVFGIEIFNLYVISNRWYIK

SEQ ID NO: 21653 - protein, 69 aa, Candida albicans
SQGCFQLQAHDCYQGSVLYITSYCVTSLTPTHQITSYRCKYINSTFSILHVYVCLTLLLSKLSQPSLNH

SEQ ID NO: 21654 - protein, 91 aa, Candida albicans
LYCCQNCPNPPLIISLSFQGMLSFDVPTITNDIKIENFYPENKFTNLFTILYCCTIFNSSFYSFQLSLFNNFSSLFIFLSIRKITLHKSWW

SEQ ID NO: 21655 - protein, 61 aa, Candida albicans
FLNYIQLNERTGTKIKMKNHMDTLRENSDKTWEEVEEEERFSKQHKKVYAATPKTINEHKT

SEQ ID NO: 21656 - protein, 71 aa, Candida albicans
CLFYTHKKITSIFYHTKNYYVLHAHKKLPYKKITSIFSHTKNYYVVHPYKITIQKNYYVFSHTKNCHTKKC

SEQ ID NO: 21657 - protein, 138 aa, Candida albicans
INLNCPTNHNDKYNNPENAIEECPEGVDFNPSDKYIGPNGEVQTSIPTNLFSGVPFCGPHLSKKSGRGLLIQHFNTSVNTEVTQTLNQSPKQDTCKLCNFSKLDSPRYNEIKLIIRLGINTEYRYNWLSVTCSWVANG

SEQ ID NO: 21658 - protein, 72 aa, Candida albicans
LIFQREALSNQMYSIDKMAASGIYTLLALIVLTIIVILLLTTSKKNSSYLIDTEYERTIDILSQFVNPASLK

SEQ ID NO: 21659 - protein, 263 aa, Candida albicans
  UNSURE (154): Identity of amino acid sequences at the above locations are unknown.
DGSKKKEIPFSILCSIQVNIQTRNSHYNMAKTRSKSAATAAATSPKASPTAAKVTKNKVTKPSTASPSKTTKTKAVKKTTTKKATPKKEEEEKKEVHVETVTKDSSLIPEEITEKAISELKKYISRQSQQQQETENDESKKSKLFDEDEDDEDXKRNESFYLTIDSKKFWSSKPQFKPKSFKLTKPLYDNNQTTTTTSNSNNDINVDNNICVIIRDKLVKSIDELNELENNQSLSQITQIIPLNSIKTEYKSFEKKRELYHQF

SEQ ID NO: 21660 - protein, 71 aa, Candida albicans
VFFINLLVGFIIPHGLIFVFISMINFYSFFNYISFVSTLFVTKYILIKIRYSKIKIVITVYKFNEGLYALG

SEQ ID NO: 21661 - protein, 72 aa, Candida albicans
FVGFNILTNRAGEEKWVPEITNVGEKQHFIEWAKNFAITHIHETGVIPDSGGSTNMLIQPFFANATVVIPRT

SEQ ID NO: 21662 - protein, 116 aa, Candida albicans
KFSNNCSRERFATIFFTNLTSAVTRNITIGEAKHRNINLIYTSKLQNFVDTSHTPKSETSDNKKCGECKQNLISSIFIFWPQMINRHLAKRTVLGLYCFNYLNNQTVLLHPQLVKT

SEQ ID NO: 21663 - protein, 67 aa, Candida albicans
  UNSURE (1): Identity of amino acid sequences at the above locations are unknown.
XSSQPTVKTQHTSNNFVLTDILFFTDEGLFGKNDKLNNITKTSQFNSVVSLAYALKLLTIHAGCSNC

SEQ ID NO: 21664 - protein, 62 aa, Candida albicans
KISCSWRNKKERKKEKSNSLSQITVNYSYTIYFNMSKDDKDLEEIWKLFQDSNEDVPKEEKK

SEQ ID NO: 21665 - protein, 95 aa, Candida albicans
YVLGPLVTIGYWRSPFKRSFLLITYIVFFLLLIIFLFQIQSSINYIYFFFTNYIEYNFNFNFFLLKIMDSYFLYCRIKFFFWVENILKFFTCFIK

SEQ ID NO: 21666 - protein, 172 aa, Candida albicans
YPYPILSYLTLSYHSMNDNFNSSNFSSFKNSPTLLTLTNEQLNRLWNLILKFDRISITSTDINIEDTDNNSSTGDDQFISIEKFYKLLINYHKLIELITIKNNELTIMKFQCFEIIRNIQQQQQQQKPNTHKMFNQHNSTATYSSSSFSSFNETGKKLQDIFNPKEEFDSTI

SEQ ID NO: 21667 - protein, 85 aa, Candida albicans
WYFRVFIHYSRNILFTHQLYPLLLLLLLLLLLLTEFYFMPIIQSYIYDDYTILIQTTIFLLLSFKLFDSINTNMKREIPELIVFC

SEQ ID NO: 21668 - protein, 86 aa, Candida albicans
KIKKNVNNKNLLVFNCPCTFCGISSFKFVSLQQQQQQRQQQLYIHTYIHTWLQLFHITTDFSLKDQQYPTRRSQQSSLRDSPSAII

SEQ ID NO: 21669 - protein, 357 aa, Candida albicans
KPILKKKRTRISKACEYCRKKKVKCNGCQPCLNCLQSNNGNCEYAVDDEKKPKILKKKKSTSLKSKLNRDRQNKALDERLSKIEGILAQLAAGIGTNDNTSTLSPVSGSNVPNGKEAKTDKSSPLQLPKEIREESANGHDEKHDPKVESNFHGSHSVINIFCKKSVEWLFRPVLSKCNQDIEVFKDIAKVNDLYIQAFLDTISQPIKARINRRNDLMDNTFANAKIPLEILSCYDDIFLVSYVCKGDDIRKLFQTYFEEPDQNGSRRRSFLWSELLLMTAAVGICISVLIDDRNNTKDTDKPKYSCSLSNQQLIEINFKCFYSMIFYHRRLCVIGEGFSTVTAFVLLIMYFDFAVPI

SEQ ID NO: 21670 - protein, 419 aa, Candida albicans
PPGMQGRGNNAQTPLQQQRFNMSQRQMMAAQQQQQQQQLQQQNAMAAAAAAAAASGRPVPQRNPNYNGSPNPGQTLPLNNNNNNSNNNNNKTGMYNPNALATGMPSSNLQRTSSAGNSRGHTPRMVNQPQPFIPHQQNQPPLPPQQQQQQQQQQQQPTPQLPPQGQTPQQVQMGYPKKVNNGNLVANQSLKSGPMGGPVPMGGPQQARILPNSSFQQSPQTQFAMPPNSNGHINPQQQQQQHGPNQNPQPTVSGRSPIQRQMIIATTTATGGKGDTNNSVQEQVQQEINTRIIKRNLGNAAIIRVLDLIEFISNQHYENLSNIEFWTKITPANFLPTAILKFNTTNITGANGNKSLNDITGLNLNFLNSNKATSNNNNNNTNTNTNNSNNNNKPHQFELTTSTAPRLLLVVYTASKRRN

SEQ ID NO: 21671 - protein, 64 aa, Candida albicans
SLSNVIFLASCYLTRNILVELSVEKTLLMKGANPLDYLQLIHSCPFQNHFFFSRFSSNSNIKNK

SEQ ID NO: 21672 - protein, 143 aa, Candida albicans
RYHLVFDIFTKLEYLILNQSENSTTSVGNGNSYSFYLSLIWPIFMAASEISTINENCESLRYLTLQIFDKLESNTLGNTNKIKQIIINIWKKRDLINSTIKDKPTNGQTKDDGLKSKRRKRLMGFVNDWEKYVVEEDYAIALT

SEQ ID NO: 21673 - protein, 67 aa, Candida albicans
NCFIGVLVKTKSTNYESIIVDKNLGSLPRIMSFFMQKLYTNEEFVSNSDLRVVVVVVVVIVVHINYL

SEQ ID NO: 21674 - protein, 80 aa, Candida albicans
KNREGEPKGLDLVCKPSPLSRKIKLGYKPVKTSLIIPYSEIERECVYVLFMSCYITIVLIILPSGEMASKKRKRLQFFSI

SEQ ID NO: 21675 - protein, 81 aa, Candida albicans
NSQSLSNDRVKEMIFGGLMARTSHDKIYQEIATKGGTREQGTIKIRNLKAINKKKKRSKTDMVARRNNSNRRLKEMMVTIP

SEQ ID NO: 21676 - protein, 104 aa, Candida albicans
  UNSURE (38): Identity of amino acid sequences at the above locations are unknown.
EIFHYNQEFDGDILEGANLAIKGGEFLANLINQCKDRXRQGDDDDDDDDEQLVRFNEAKKELNIVNVLKKSYFDEDLNLKKSNDNKETDESYHELINKWENEMK

SEQ ID NO: 21677 - protein, 73 aa, Candida albicans
RRGDNEKEHTSIERKPWHNIINGKSKHQKAYIYHPIHFLLCKHYYILKNSFSRYITDVNTLVFYMFQGLEGLI

SEQ ID NO: 21678 - protein, 178 aa, Candida albicans
RTMKFLLLLLAGVAIAESSVEVAPSEVVPSVEVVPSVVPVEAVSDLQIKASVASPAASPTAATTSGSLFGDLVDGLFGGAQNSSAIATPTTTATAAQSTGGFLDGLFGGSNTVANSTGSSDGSLSDLFDEWFGPSNYTKTAGAPSSSTGSILDGLFDDLFGDSGSNSGQQSLHHGAGR

SEQ ID NO: 21679 - protein, 71 aa, Candida albicans
  UNSURE (27),(28),(29),(32),(34),(38),(39),(41),(52): Identity of amino acid sequences at the above locations are unknown.
RTNSYQELFLVEEKHWESFTFVEQFDXXXDDXDXVLWXXAXIEKNVFDHFTXGSIRKLPMGTECYSLQKSH

SEQ ID NO: 21680 - protein, 292 aa, Candida albicans
KTPKVFASDDIDLFVGLIKLPSEIISTIISYTLKCRLPELLYFPPIREIVATEILTNVYIRKRIFRHRDDLEVSYEGFDFCDCDHLDIKVNNLKQGIRQWNIFPKSISIDSEVELSDVVNTFPEILMDALSIKCYFDWKCNLDQENLLRLFSRFKIRLDNFHFSHSSYPFKIPPIATHISLHCSSLTDYAIPNVKKFNIHAASNVVRNQTFTFSPDLEDLDIYTDQSIQVIVPPNLRRLNIRTINGLTNLVFKEMPNLEYLLLQLPNIQSFDAAEIIAPNLQSLHHGLEDPR

SEQ ID NO: 21681 - protein, 83 aa, Candida albicans
VRVKKKKRTQRNGLTKDIKAILYFNGSFHFIVVISIQQINRDIYPPILKSIFKSEIQIVKKKTEKKNFLNYVSLLFIICNNNK

SEQ ID NO: 21682 - protein, 68 aa, Candida albicans
SNNVRKLVLFIYSIKRRGTFLCYFFKLYIIGCKSKIEIYRCLRDDEITILSLKNKENCLINQIMKFLI

SEQ ID NO: 21683 - protein, 60 aa, Candida albicans
TKVTYNLNNNLNPTKKRVVHINFVAITNTYYNIFSTNINTSGITYYYYLLLLQIMNSNDT

SEQ ID NO: 21684 - protein, 288 aa, Candida albicans
PKNNQLIIDFKLLILLLRLKNFPNMNLINELYKLIYQLRLKRNDNINNDQISLLLVKNLQNLSYDNIVILTLTKNYLTLINFLSNLIQELKELKDSEDKKQNMANSFDCDYYSNINLIYLIINLIVHHKNHNQNHIDVVINDTNFNHIWNTQINETTKNSLIYTLQHIPPSIASKHDNNPQESSIQFKCDSIKDLGQLVQEGKITGRIICSMLGIWDLSNTYGFTLSNNSNSDGNSALQFTKINSQEDHQQQQHLDINTLSKDEIINKCCDLLNDQWCNYINKVYGLE

SEQ ID NO: 21685 - protein, 67 aa, Candida albicans
IIITNGGKSKQKVNWKQVLIKSRRNKLNPINRQEKVKTKNVLIKISFTLVLIDVLIVGGGWVVKKNC

SEQ ID NO: 21686 - protein, 103 aa, Candida albicans
RRIMKKKKWAEIVVLLLFTHPNTYNKWQHKNSTLTAFRFLHFSPSTSTSTSALIHYIYIYYYYYLLLLLTNHLKFFYIYFYISFFLSFFLFLIYLFLSSLTSV

SEQ ID NO: 21687 - protein, 119 aa, Candida albicans
SFEIFLYIFLYFFLSFFLSLSNLFIFIFFNISLINSTSTYLLIFYKSFDYIHHHPITSFYSQKFFFSLLRNSFSLQVWRPEEIYQQFFFTTHPPPTINTSINTSVKDILIRTFLVFTFS

SEQ ID NO: 21688 - protein, 72 aa, Candida albicans
LVTINIRTQIRVFLFINRKFSIITQKHQKKQQQQQHIIMNNIIMNKLVRRFLYSGLSQKKFQLLFLTSRFIE

SEQ ID NO: 21689 - protein, 104 aa, Candida albicans
LSLITNTTMLALSLLSIVSIASAAGVTAIPEGDNPYTIFPSVAKTASINGFADRIYDQLPECAKECVKQSTSSTPCPYWDTGCLCVMPQSVGFSTSRDERHCTP

SEQ ID NO: 21690 - protein, 86 aa, Candida albicans
HCKNKPNPLVKAASNMINVPKMIPSVEYANGIDNKPAPIMVLTKLIDEETVDAPASLSIEGISYILLKWWLKRILMPVNLIERPLK

SEQ ID NO: 21691 - protein, 60 aa, Candida albicans
FWQSSVLQVLTSISFILPALFGYKLIGSELDDPSTLEIAFQQFVFGVDFLGWYCHDLVLI

SEQ ID NO: 21692 - protein, 168 aa, Candida albicans
MSTYHPSFGSSGGGIGSVFKSITKSFKQSSSTKRVPVTINPTVVGGGQDLQNLIDQLQTSSSSSVKLQAIKKLIESIQNYLISSVPEIWYVARNNCDIKIIKHSRDLRRATLELLNACIEKDDLTSVGTRIRYFNDIFKNCMCQDNNNNNKCDPDFDLFLKALLVLTG

SEQ ID NO: 21693 - protein, 62 aa, Candida albicans
NIIKITNPRYVSKKLLALDFSPKGKIANQNSATKTNTFNKIPNQEPMTPVCDTNVNSSVFLP

SEQ ID NO: 21694 - protein, 85 aa, Candida albicans
SKPGRPNAPEKKKINQFDSRFFLIHKSFKQRHFSSFFFYITYFVKLIIIRGVLMPYVKNIYTYFLFIYLIYPCINGFSLLLVWLI

SEQ ID NO: 21695 - protein, 67 aa, Candida albicans
ICVLLRKVRLVYLKLLNVKIMNILKWINLKPILQLLKRIRRNRIGGNHYEDHEHLRLKNKSNYRQNM

SEQ ID NO: 21696 - protein, 64 aa, Candida albicans
MAVRALNSLQKSMALTPLEPNAGPTGGAGAAFPAYTTNLTNAPFADMFIEGGKEVTLNRRSSID

SEQ ID NO: 21697 - protein, 76 aa, Candida albicans
  UNSURE (49): Identity of amino acid sequences at the above locations are unknown.
LYLLQFYLFELIYQLLLLLLPLLLLPPCDSILNFNFFFNGDEDDNGFVXKTKNNGTEYGLTQEFKENPHIINYMMN

SEQ ID NO: 21698 - protein, 62 aa, Candida albicans
HTHNMNKNGSEKRALLEEKKNEKKKQKAQKNNQQIIVQVTGTSNRTTFQSEYCTNIDSTLWK

SEQ ID NO: 21699 - protein, 205 aa, Candida albicans
FVDCFFEPSVFFFHFFFLLTELVFLTHFYSCCVCAKKTSPFIILFDINHTHTMSLPIPDLRFEQSFISQLNKYAGNKQPDQKKLQPLSSKKYNHIATLTDDDLKLMNEELDIEEEEEIDNYTDKPQPKPLAPITPSIVIYAIIKDQMLMPLLQGFLWTGVLLCVRPLLKLVVRNGQYAGHWVSNLLGLNRLATSRSSLHSRRSFS

SEQ ID NO: 21700 - protein, 243 aa, Candida albicans
NMDKLETFQRNDPRKLFELANQLNERLFFAIFLNETQFKIINHILSLDNFEIWTNFLEGNCYISYLQPEDKNDKPETPNTNENNESAGGERIQNNSSDRDTPTLNNNDKKNDSNKETMQAELETPETLFPEGAEMIKKLALHVRYLLWEKAIDFYYNSKVLDESNNILDEVSDDYQLIDSLDNIVDEKASNELEKKEAVEKLKVREIEDDYDDDDEDEDEDEDNNDEPTTTDLLSTPTMTDPC

SEQ ID NO: 21701 - protein, 68 aa, Candida albicans
DTVLKLSFNFLLRQTTTTTTTTNKRDKEQKSETLGKGSEGKKNQTVREKLIENLKVGVQIVISFQYII

SEQ ID NO: 21702 - protein, 194 aa, Candida albicans
GLSQGLTFASSLPGSNAKGAQLQACFKSIENSGKFNVNWYEVFNHVHQYLFDSSQRDIQPSVGSITQFLSSLDFKQEPIDIFLNYEWWFNKTLLYILHSLDASQGGYDISLLPNLAYCFEEDKTTPQTRRNILKFINVGKLEIKVITKIQQQQQQQQQQQQQQHQLSEQDKKLNAFLNQLFEHDYRGSILPTGG

SEQ ID NO: 21703 - protein, 339 aa, Candida albicans
YVLMDKEYLIVIGLDSSITSYLVKDNFEKLSVIHPPTRFKTFCYKFVKSDDKSYLISAFTGKIVVSEIGGANYEFKLDTYAACNSIVSGITNGVLTLLLSFDTGKFKTIKFDITSKDFTQVPLDKSIIAFVNKSLYAYQFQNDNDSSKGTPEPIMKLFGINSLPNGTLAIFYKVTSANVIEYRSMAFLDVNIRFLKLSEPIGNEYQVHNRTSIAKFIENCIGDFHNFPTISNDLRLLRKDRVNKFIENFKTFKEQYLLSNFDFGPDLHPLSDFETTLKKNFIENSVVIQAQYLYILATFIESGLTPISFEKPTEVDVMVKEIQDYKKSIENSIIIYLRK

SEQ ID NO: 21704 - protein, 65 aa, Candida albicans
KRCQISGWLRDGAKSNARPRRERTAMSLEGILANCLKAEKIASESQRKYSWERGPDREKGNEDGV

SEQ ID NO: 21705 - protein, 88 aa, Candida albicans
SLSNWQCALREVNSGDMGIRCWKFTDGETVAGQASQGFAGNYCSSGMIFKGLETTLRDMEVDVAMEVARELGSTERMNSQAIFFCSRV

SEQ ID NO: 21706 - protein, 269 aa, Candida albicans
LLPPYSNMDKFIQSFSHQYLDSSSSLKLTARRKRKLTILGLFLFSLISLMIIISYSNNNILPGLSGISISSTFSDYYSNPKQQNKFEQQIQDHQTTKKGKRTIIFPNNFNHVHDHKGSYMMKDSELVKYYVETMEQALDPEDLIYRNRFTYKLPNIPYTEQKIEMFSDGGGGGGDTSDSNTDMCPKLSTTIKVEASPAMNKNGDLKKILKTFLQEDSFYYRELSPFFPDLKKHFDEDTIDKHWYQFIGSTVWLEQYGVPLMVSRIHYYE

SEQ ID NO: 21707 - protein, 86 aa, Candida albicans
LMGKKKTNEKGITFNTNKKGRNRKEIERGNGKKESKSKIYKITIPQLYIYIYIYILLSSSSKTTYELESCTNKFKKKKKNFFLLLP

SEQ ID NO: 21708 - protein, 62 aa, Candida albicans
ELHDRKFLYHMNLFVRKVNKIKEERKKERKKERKKEHTNICLGKGKGKREKKILCVYYIKSE

SEQ ID NO: 21709 - protein, 100 aa, Candida albicans
IEGEREKEKEKEKNEILFNSETMEQKNKLREVSNCYLLITIITFTTKKLDFFYSHTLSLTHSLYSTHTKFFFLSFLFLFLNIYLCVLSFFLSFFLSFFLL

SEQ ID NO: 21710 - protein, 71 aa, Candida albicans
QGLGDSFGGETGYLIGQQMALKYTTKLSPILAIPQLVVLTISKLLFNNHTIVQTNYTPLFLNVINCTNNVA

SEQ ID NO: 21711 - protein, 65 aa, Candida albicans
VNNLSLFSIHYIVLRQILLELDPLHSCCCCCCCLTGYFIFSAPWLVSIIDELLRQSTTIHVNLVR

SEQ ID NO: 21712 - protein, 126 aa, Candida albicans
EPNKNRGRHCHDPVESLRSQNFNVRNKHDKIGQVRNQHRHDKLMINREKINDQQSKRDINDQYEKEYESITEGLDIDRLIEDEQNNTEIQGWLEHYEEEAEEREWEEDADLIDMIQSLELEDKEMN

SEQ ID NO: 21713 - protein, 91 aa, Candida albicans
AHDFHPIIICLLTKTKHLKSLMCHNQTNFFNPYQMCQANSFYQPGPVLTASYANDEDNADEQEGNSSSNYETSSSEDLEERECDLDYGEHE

SEQ ID NO: 21714 - protein, 77 aa, Candida albicans
RRKELSRVSVMLDGEAKILDKTVDGKDFDFYKSLHLNNSKIDYAQVKNYIENDDNALIIIRITNCKVTDTDNNVELY

SEQ ID NO: 21715 - protein, 79 aa, Candida albicans
EDGSSTSMSSSKNSESKLLETRDVIKSIVEEGDSTTGNVSEVKYVHEYLERSPQSTAIKEEDLYYGSSHNTPLTVHKTL

SEQ ID NO: 21716 - protein, 64 aa, Candida albicans
KLNKIENVIFVKFVNAEKRKIYFKEKQFLIVEFRIYLKYELSTNEQINKKKLSTQYTKSLISID

SEQ ID NO: 21717 - protein, 77 aa, Candida albicans
  UNSURE (61): Identity of amino acid sequences at the above locations are unknown.
TFLHYYFRKIRASQKAKQSKAKLAYSDNHYFYRKSIVVVTVLVDINFVFCGAVQVSISSSXYSFSLWLVVDRQQERL

SEQ ID NO: 21718 - protein, 73 aa, Candida albicans
  UNSURE (38): Identity of amino acid sequences at the above locations are unknown.
LIPIIIISIGNLLLLSPYWLISILCFVVPCKFLSPHPXIPSPYGLLLTGNRRGYDLKLVFVDVSSQTKTTFLD

SEQ ID NO: 21719 - protein, 60 aa, Candida albicans
LGWIYIFLVEAVNSNAFHFIQINSNQFKFNFINYRLNLSILPVSLSAPLPRFPRFPGFVY

SEQ ID NO: 21720 - protein, 68 aa, Candida albicans
REAIIHEILRLHELAQLQLTIADLPHKFWALFYLTGKLEQRKRARSYNIGLIREIKVICKITTTSYKN

SEQ ID NO: 21721 - protein, 82 aa, Candida albicans
NAYPPARGEDENSKVTPKDFDKYLGSLRLKLSNLKNLMLEVEGINETLSYTLDKIESLKQNNIKKEAFLLNFKNSVNMNEEI

SEQ ID NO: 21722 - protein, 370 aa, Candida albicans
VTSSRILTLVVKIEEDETYFLKIDTKEYYDSYATINEDPTDTTTTTNKVEINMINPNFEKISSKLSNVKNKPTTIEQTDDKSLNEAIEDVYSYPEEAIGNLYRLDRNEFFPTNNNNNNNNNNNNNNNNNNKPNKEIAYISGLNHEKRRNELSKSIEVIEDFETRHLDDLFKVKKYHLLTRLKNLQSSKISFLNHTSSNMIKDDELLNIEQDLALERDLELLHLKLLENYELLKNSLNFYQNSHKIYNHLNYILINKLEKLKTFFEIQKNLFLEYIKKDDNDDNDDDDNGNSRNIFNINEKESNKLFIGISNHDYSNEIKDILKNLIVNDIQQSSNENNTPKNSDSNSNSNSNSIDSLRITRTNKNTIIIK

SEQ ID NO: 21723 - protein, 81 aa, Candida albicans
TSSFSSSTQSWLSLNLLSKFFDVSSRVCLLRVCYNFCIEKKDQTNLKKKKEEVLITKHKTKLQTLMSFSKKYGVSFFYYEY

SEQ ID NO: 21724 - protein, 61 aa, Candida albicans
KLISSLVLQRNNRTIVKKKGISRSLDQFPKQRVSLNKLETIKRQNLILYLVNNYIWNLQKN

SEQ ID NO: 21725 - protein, 62 aa, Candida albicans
TQLLEYSIIIWHCNFFFLFEHIVVVVVVVKKMVISRIAKKLIHLESINILVRRDMYYVYSSE

SEQ ID NO: 21726 - protein, 88 aa, Candida albicans
KSGINFINEDLNKKYKKVLKDLRFDKMMLIIELIGNFLDLTFNLIELYGIALPDWIMSLLNFASMAMTIYRMNKDDEYVDDDITDDLI

SEQ ID NO: 21727 - protein, 72 aa, Candida albicans
SCMCWQHLCLYGRIFFEEIKAKNILRLIHATYRVLVVALSYTNRLIKLTNNLYQIKSSVISSSTYSSSLFIL

SEQ ID NO: 21728 - protein, 66 aa, Candida albicans
IKSAFSFSTVKQTYTYSFALVDSSMRLYIITIVIDYLLTSHNHILECSERCDQYAIIDNSISSGGN

SEQ ID NO: 21729 - protein, 120 aa, Candida albicans
  UNSURE (108),(111),(119): Identity of amino acid sequences at the above locations are unknown.
AKMGRRAKNKQGVPPTFDEFQASKLKNDTKRKRNGAKEQKNDLPVSKKPKSSTSSSKQTDRTESSKPKPKTKSKVTKDVEVEEEVENLPEVDLEELASAKKSLFDDSXKEXVDDEFDVXR

SEQ ID NO: 21730 - protein, 168 aa, Candida albicans
LIQIIASTTTITTNTKMKFFTAAATALLFSAQALAGITQYTLSIEADDKRLNGKGITFKHEGAGINYAFVSDSSAKFSYDDESKLFYYPISPQLNYNLGTAGDIVQFSVTPPSSVEIGDDGALKFEGSDELFAAVSINDPHHYSDKDFAVIVKGKNHAIQIKLVAKKA

SEQ ID NO: 21731 - protein, 69 aa, Candida albicans
VVVITINLDPIQQAQFINRNYPALSHQVYLSKGYKLTIKINETSVVFPKITIKVYPSLSFLIFPPLYSI

SEQ ID NO: 21732 - protein, 198 aa, Candida albicans
YFLPSIQSNKQVEGVMTHITDLPEEVLFQIYKYLEVSTLKALQLIPDFAESTRYYLYRNSLYLLRICDDQINSLTLTNKEKPLGYELSLLVQDNNNQSMKKHISQFRHYQVNLLLIKFENLLEKLDCYKDNIIQDIFNRDDIGNGIVSVKLLIQLNYSLSTFNQVKDCLVNMDKVSKYFSNNGKNSITIDLELNSHDK

SEQ ID NO: 21733 - protein, 84 aa, Candida albicans
DRKDGDRDRDGDGDEKITEDTKQELIEYTNFIEALKLIDDWKLFIIQGHPFNGSSVNSSLEKTEKVLKNILQNWLLELNNDHEN

SEQ ID NO: 21734 - protein, 118 aa, Candida albicans
  UNSURE (68): Identity of amino acid sequences at the above locations are unknown.
DFKQSVILQVLLLLLLLVVVVEDPPEKRTIVLNYNDFLILFIFPIYEGCISTNVMKRTLRTHSKLTNXNLCGFLPVVCLNNQSLHFRLRGLFLGFFSFNIFFKNFSTFLALLTFITYI

SEQ ID NO: 21735 - protein, 289 aa, Candida albicans
TLTYTMENYLLSSPTQLSQPYDDGTNSLLFMDNYELSQNLSQPLDQHLQSLQQQLQVQLQAPQQVQLLNQHQQLPQIQPFPTLVNNQQYAQETFQQLSQQHQQQQQQQQQFSPFQQSQLQQQFQYQYSQQQQQQHFQQPVTIEEEIVPASNNTNIQISKFFDDNKGDDEDIANSGNFNEFDHSRNISLDDTTITDLHRRENSINPPTGLPHSISSNTIYSYSSFESPQSHIQSQPLYSQGYHNQNSLSTPLRRNKSYSKSSANINQSPVNLATTAMNKNYKTPLRSLND

SEQ ID NO: 21736 - protein, 67 aa, Candida albicans
KISSCNNNNNNNKQFTIIKLVYAFYSYVNYHLSYFFLCDGDGSGVKSNSIHTHYDGREFTVHLDKFS

SEQ ID NO: 21737 - protein, 78 aa, Candida albicans
IMTKIFDYEKREILAKNSHKTVSKLICAYLRTKLNLNPVQSSPAQLIFITTLIVEYFIFIKNQFMQQQQQQQQTVHNN

SEQ ID NO: 21738 - protein, 80 aa, Candida albicans
VKTAIIKRQKSFSNPQNYAFIKWPVLLSWKNLIPKNGFFWTWRYWIPSPKPVLKSSNKDPKKAPLQRIGSNGLKGVMFEE

SEQ ID NO: 21739 - protein, 365 aa, Candida albicans
SVLSSLFVVLLFYFFQHLLPLKIQLYTFHLYLTGNNMTKSYMPLFRSPRQFKKIYFILIPLILAVIILHVFFDGFNKISEYLPTFISNRILNHQDQQQKSEKSSDVISSYFPSLAIYPKNFDNRVEFVNEPKNSKWIQYFGDSKTVLSNYITNQTYTNHSIGLYSSSTVRPPASLCKDILYERSFEITKYRTLHDDLYKLATTLLYQLENDPAFQDLSPFFNDRLPHIIMRGELHKHIYKFAGTSVWLEQHGVHLMLSRVIYSQQGKKNDPQLSLLYAQVYDENWNELNDIELIVPVINPNGERVYDSVKYPQFVAIPFYHNSEYIKSRWYGPEDTRLILTKNKFGDDEPVLIFNSRLTAGWKTR

SEQ ID NO: 21740 - protein, 63 aa, Candida albicans
LLAPNVEEDVCVCPNGELVEDWPPKGFEVLLLDDPNGEEVLVGAVVAAVFEPKGEFHVFSLRI

SEQ ID NO: 21741 - protein, 170 aa, Candida albicans
NSPFGSNTAATTAPTNTSSPFGSSNNNTSNPFGGQSSTSSPFGQTQTSSSTFGASNQTQSAFGTASTQNTNLGFGSNNSASTIANTNQNSSTTNNANPFGSTSEATPTFSFISTQPKSQPQTQTTRSIDVDIQENTQNDSLPALILEAFNASMFTLGKIPDVPPPPELCR

SEQ ID NO: 21742 - protein, 107 aa, Candida albicans
SRRIQLNPAMRSSGYLNSNNGSSSSLESTNVNKSTDKNQLYLKVVCNCATDLVPQDTTGTGSESKKAYSSSKSINPVLVVQLNNTIKSTSKKLTTNQRFHNGLEGPL

SEQ ID NO: 21743 - protein, 84 aa, Candida albicans
EERGFEIKLDNFKSKKLTIQSSVTVVVLQSTNQMTIKLTYLDLPLLVKRWLLCTSECIFAHVRPRKSKQSLSALVIYTFWEKGM

SEQ ID NO: 21744 - protein, 68 aa, Candida albicans
TTLKLLAHCQTLYTLCTTGDIIFRHKENCISKFKNLKVCFNLLLLQMTLAAQQLKHSFVCGLFWDCLF

SEQ ID NO: 21745 - protein, 79 aa, Candida albicans
SVVPVHTFSYVTLEIDGLPLAYPTLMSTRPLFVNCFLNTFSTPQKQPAERLMSLEVEVLRIVGEIVDTIIESSGEFVNV

SEQ ID NO: 21746 - protein, 146 aa, Candida albicans
SAGPSSPVVKNLTNDDYLPLKRLFQLIEFTENSERIYINCLRKIEIGYWHRFFSALETTPEKFMKRLIAIDNVELCYNYLIIYLNYKNEGDTETDELNDHDKEVILKIIKMLESSSKWDWCFELCRFIKILEPSGDFLRQIKQELE

SEQ ID NO: 21747 - protein, 63 aa, Candida albicans
TLNTQNQMETKSRVRVKFPPTKVHHLVRKKQTNNEKKNIPSPKKNQTTYIINPFHIYIYTSST

SEQ ID NO: 21748 - protein, 78 aa, Candida albicans
VNFIYQSIHLSINQSINHYIISRTVSIYPFLSRHSIFDKYTPDISSHTSIHLNLTHYFYFFNTLFYLVKQSKSNHYRY

SEQ ID NO: 21749 - protein, 82 aa, Candida albicans
VTISLIMTSQIADGSSTTTINPLKNGLSALKPTHQAHGTSTTTHLTNGFTKKIKSYKRLELERLIREFQNKLSKIGDNIMKL

SEQ ID NO: 21750 - protein, 66 aa, Candida albicans
NDLKKTCMSFLSFTLFIPSLFFLMAPNTSGNIWSNGPDGKNYLSLLSNMVSITFASFRIENAVGSL

SEQ ID NO: 21751 - protein, 241 aa, Candida albicans
VSHVCALLKRNILGFRITKVNLLHDPLLFPVLKNTNDAEKELNKMRKALTNAVVTSVGRHGKYFWIRLNNHNTTNVLLMHFGMTGMIKLRNVHSHLAFMENGGDKKALEKLERFRYKDSRIKPDVEVKQEWPPRFTKFNMELENNDKKLEFAFSDPRRLARVRLLSGLEVSTDESLLKLSPLNAPGPDYSKPEVPPKETEPSVFGDPDSDKHGRARLSIDEFSALILSKKKPIKNLLWDQT

SEQ ID NO: 21752 - protein, 176 aa, Candida albicans
SWGFHASLVADSDTPELRKHGIKRFQLAAHQNLSRDQKYEGDFYINDVELNGPFAYWLVTASQRFEPTFEISPKGDILKDELYVVTFNTQNTQYYIMDIMKEVYDKGSHIKNPNVVYKKLDENDKILLKTKNSKPLIQRRFCVYGSIIALPETESHEIYIHVKDNSQHSWKLYIIH

SEQ ID NO: 21753 - protein, 68 aa, Candida albicans
RFNGSVVPAENNLMIASNGLVIFNERDKLLPVPPGIGKIAISPFSESFNELMNSLIEVSPLMNIIVTL

SEQ ID NO: 21754 - protein, 134 aa, Candida albicans
LKQQDVPLEELDQRPQINVNDKPITDEPKASPAMKQEPQSNNENSQNLKSKESSNPNNGSSSSDSDSDSDSDDDINSHFTATSGYQRESNECTEFCIECCTCFGVLNCCPNNGEGCVTNMATFIGNMLFACCKC

SEQ ID NO: 21755 - protein, 104 aa, Candida albicans
HQKLSLPHKLLFLILIMNRKSTLNQKRSATISEFRFITEENTEANALLQQEQQQPQLKQDQSLLQQHKRTQSQTKLTKVLPYKVTRSKSVHAFQEYGKGFVGSP

SEQ ID NO: 21756 - protein, 69 aa, Candida albicans
SVCISLKMEDKRELLKQPIHGIYIPIGLILFGTWIFGWEYMPYSIGFIVVIVSIQYYGALKRASFYASS

SEQ ID NO: 21757 - protein, 186 aa, Candida albicans
YQDNRSIIIMRSILPISVLVTTALSASMSTIRSTTISSLSSCSSSSSTEPSSSALPVAPNLSSARYQNTTIQTIQPNSASNDISSIISSDSEAPETRYEYETDTDYTHVTKTVCDANNNCYVTVESESLTTYTTTIDGVLTVITTAVSASAAATATAESTIASTSTSSGATVASPISTKAAIKSSS

SEQ ID NO: 21758 - protein, 101 aa, Candida albicans
RADDKFGATGKADEDGSVEDEDEHDDSEEMVVDLIVLILADKAVVTKTEIGNIDLIIMMLLLSWYYNIYIYIFLLSIIIYMKPVVSIWLLLLLLLNFLRIN

SEQ ID NO: 21759 - protein, 146 aa, Candida albicans
SILINNNNNKSSLITMSTGLSNRVMNMKFMQKAEDSKLGKQKLEEQKKIHDLSEWVLPDLAKLLKLAAMKPKIDRVGFGTIMTNGNYNYSSTTKRSWGSNVSFEEIKDDDSNNVEDNDDEPLDLNTMWRKRKLESPSNSNKKKRLL

SEQ ID NO: 21760 - protein, 492 aa, Candida albicans
IYSFRILGRDSEKFFGFENSDFKVNFNLPKLRRKINENMAGSEAWKESGYTEGNGFNLRIIFLLTFPNIQSFSKTGIIAPNLKKLVLIHYHISNYDGLKQFQHLKDLELKCLSFSMSLFDDGCLPELESFICWNCSIHNTGDFDNSQSILHPNLKALDLHNYRFVNTEFSNWVLSDTLKIFCVSDLLFKDGFLGEYLKDVDVSGNELTLDSNFRIFHMVEKFILHPQYLTFESLDFMYHLPNNILRLHLISNGEGKMSPLTQMVKWPLMLTDFAFRNFNIDNQTLELLNMKESNLEIIKICGGDVKKLFADLFPVSVKDLSLNDMGIQKLPDSFENLENLRSLSLFENQLRKVNSLKLPVSTLQTLNVCRCNLHLISPFLVSMLEEKNKNAELEICAWGNTNISVIDIRTALKSIKGLSLEVDDFDKTLTEISKHSSRLQCKYFVYDPYSKESKSSATEEVALDYDPDDLYDGSDSSLDEEDAGGDIKRRKM

SEQ ID NO: 21761 - protein, 94 aa, Candida albicans
DLIGKKANRTPRIHLLVVSGFSVLNGFIVRSFIIVEFIVTVGRIELPRDKQKTVGKQVVVMSTSDLSNELKVRQNATFQDNDFKHLGASSNTSI

SEQ ID NO: 21762 - protein, 304 aa, Candida albicans
  UNSURE (297): Identity of amino acid sequences at the above locations are unknown.
FVPKLKRKLEGDDDGDDFEYDEEDDDDDEEEEDVTVIDPPMKRQKVATLGEPWQSSTPAKSNSSNHTSGAANLAASISESKINAVVTTTPKTTSTPRFVIDSPNRPILAGKNLTYTSSFSCSSNFELSPVRPLETGPLLEPLTPANNIYRNFQNQQQQQQLLHMLLRVRTPKSTIAKTPIRNIRTPQTSSIVKKLWNSPSYLDDFYYSPLINNLINLLTVSSNSKLSTIQGSFLSYDDDDMVSRNFEHPHVHSSPILGSSSDHGVLADNKEKRKNLFQDLKNVEKNITLKGLSVSFXCPRVFVY

SEQ ID NO: 21763 - protein, 129 aa, Candida albicans
RVFPIFFSTPEERIERVLLKKIAKGKFEENFRKYFIKERGGFLGWTGISYKGQNFFFLEPRHFIPRGEENSRRPGKRGLFLGGYSKTRDFGREQIVLEKSKEVGEGKVSLFKEVHWTQIQTQGFPKFNC

SEQ ID NO: 21764 - protein, 139 aa, Candida albicans
QFIYYIAVVFSNVMGFINPGKSLRKRKLRSNTPLPAKIPKVSPFLSQPQLQYAPAISLITLPVEIIHKIFVYVGPSENYLPLVNKHMYSILRFNGDIQAESICNYPLLKSMVNSYFYFDLNIRINHQSLNAGSERNPPP

SEQ ID NO: 21765 - protein, 74 aa, Candida albicans
NTYKNIFPFLVLIYFNSLFITIILVHIEKDKKIDPTIYFTPFILSSIKYFATFILCDIQLYTNLNKKKICENED

SEQ ID NO: 21766 - protein, 63 aa, Candida albicans
  UNSURE (7),(8): Identity of amino acid sequences at the above locations are unknown.
IHIFIGXXSKGERRIMRRSWRRQLKNGEFAINSQFSDDKQINGDRMSITHKDKSFVLGFVSII

SEQ ID NO: 21767 - protein, 362 aa, Candida albicans
WSKRRKEELLNYENLDVISDKIDEVGAESSISTSNDRGIIANATANGPIIVGDSTESVDTSNIENRKLVVVNSTPDDHDYYATNDMNDNFITPNPSNESVETLAGVYKDFEVTNATEANTEAGKTTDINAETSNAIDAVADTENKVTAEDDATDTVNTGESMTDTTTSTTDNKNDKEVDKEVENAVDSNVTTNDTIPDKAANIDNESSSDNSIDATTANTTNTNNFNDAEVNTEATNTIVDNVTNDKFNSVDVSTTTPTATTVSGIPTADEMTNNVNTNRISTATVDSFTGKTGENYESFITNAGKDSNDNNADLKTPTNNSATTTTNTQSGVSNKKSNSKTGSSEQNPFQKKLMNYLNSLN

SEQ ID NO: 21768 - protein, 194 aa, Candida albicans
TDDAPQTPINPTIVAKILFSLDELSIVSSLPVSLFDSLPKINVGLAINTTPAKENTEQIASSIEYFSCNNTNAKNAVTIGTKKVNATASERLKYCNEKYIPKTPKNPTKPRNNNNFLIGLGPNGASGTDLVMAMYNRQQIYVMNILTNNICAGWIGVLKFLSVTNNLQVVTIIEFKNCDSNNRDNPMFGLIYFE

SEQ ID NO: 21769 - protein, 72 aa, Candida albicans
  UNSURE (70): Identity of amino acid sequences at the above locations are unknown.
LVLHFPNHNKRIMYYGKSLTHPIKSSLFLWERNLELVLSLRVMYISASLLIYMYNPRLICMHGKSGTSLXNK

SEQ ID NO: 21770 - protein, 60 aa, Candida albicans
KSPYAALPNLKSRIPFYSRHILNVNLITKTFKVEIYRQNYYNTKTLRITASTIIQEITEK

SEQ ID NO: 21771 - protein, 97 aa, Candida albicans
  UNSURE (50): Identity of amino acid sequences at the above locations are unknown.
KNWRKHFLPNWLKRGTDSKRNFKFLNGGKNRELWVKNFYSQRTPQFIIGXKHQHKRDLYALNEYIKELVQKVKRRRGSPILNQGERENVDAGTNVLV

SEQ ID NO: 21772 - protein, 67 aa, Candida albicans
FNTCIGFFDSTLSKSIDVSFLNNFIVLGQYKSPLVRRIIEYNLTLPLRNGMLIIICSSLSDLIIGLI

SEQ ID NO: 21773 - protein, 62 aa, Candida albicans
EQLFFIFSIADLLEFPIAGAIVSGSKQSYNNLVYFLTACAAIGAIVSFISRYLYGGFNLNRV

SEQ ID NO: 21774 - protein, 64 aa, Candida albicans
LRVWVQKKGEEKNTSKKNNFKYSPHFLSQSFGFNLYWGLISSSILLLLVYKFNCLSGWRGFVYI

SEQ ID NO: 21775 - protein, 100 aa, Candida albicans
YNSGQGGEEEEIAIYSNIDVPLFLISNPPFTISNNKLYIYMYIKPTFLPFFIFVLFSSTRTFLTNFKTILPELFDNIFNKMGTKFHWWANPILLMGGCSP

SEQ ID NO: 21776 - protein, 73 aa, Candida albicans
  UNSURE (9),(10): Identity of amino acid sequences at the above locations are unknown.
FGDHKNRGXXGGGNNQLYYSFFFLINRQQQPPPKSSQSIILIHHDNTINNLVIFNNNNSNIPIRFKFKCHHHY

SEQ ID NO: 21777 - protein, 324 aa, Candida albicans
TKSSCTCFFNYQLAYLSFFIIKSFTSFFFCCFHSTLISILITTMADSTFDEFFENDFYSAPTSINNSKNHVKNVRNSIQIKHSMSSRSLNEFTKDIPPSATTGSITTKSNTQTNSSSSKVGNTSGSTRTSIIKASPSLKALESILNEKNKLYYTTNTNIIEEVEEETEETEKVRIAKNHSQGLHSLSPPILFNYNNSNNRESVQTFETAIESLNEDDTLAVLSTNTSNSIGNNSNNNNNSNGYPLTTKTSKSSSVNSHKYNKSSVSTISESGYSTDDTPIISQPLTFQSFTPHSFESPQLKMVDITEESNFENENSNSTITTNT

SEQ ID NO: 21778 - protein, 75 aa, Candida albicans
LIEEKYWQQNKRVLKGWHVIYQSLFFFLFPVHFNDAFFLCVLGGVQTFNFIGRANAVPETSIEDLKFSCNLIQNF

SEQ ID NO: 21779 - protein, 135 aa, Candida albicans
GIFPRGKILKKFDNCFYIKQLNLWVQKDNIIPILEDQTGIPNEDILKQVQPPSSLFNDQILKLLNNEEILQEYYLTRSLTRFHDFEKQVLFDDNGNDKPLDLIKYKTYKKGLKMVKPLRKALYEYENIERIKHHH

SEQ ID NO: 21780 - protein, 165 aa, Candida albicans
RMRMVKIMKIQDEDDVEVIGDSHTDKENESSSEESSPEPMTKRTRQRTRSTHEKTEHTSPNIKKRTRQSVKFDDKPAEPSDTGSRKRRAPPGSVSPPHPPKTRRRTRSVTHEIEEEDASTQSADDAEPEIIKVETRHTTRRSSRILMEPSSSTPNVRVRRSSRKR

SEQ ID NO: 21781 - protein, 208 aa, Candida albicans
QMITKYQQSQQKTPLTSITIIETTSKTTESLYTTTSNDSTHIFTTTIIDVQTNTIVTCPTTTSTLTLSHTSDNEKPASLSSSSLIESDHIADGTTTSTTFQSTSTTTVDHHCSSCSEILLSTSSSIIGNKSTSTSISSIETSASSSYHSSEPEVMSSSSSTLIKQSSDSIPSTSQTHVSTTSSSVSSLETTTTTTENSPTSNGFSSSS

SEQ ID NO: 21782 - protein, 62 aa, Candida albicans
ELDQLMVEFNNLNLNNKATKNRLMKFPVETATIDSLKYYTMFLKINENILIDLIEVLFTYLG

SEQ ID NO: 21783 - protein, 76 aa, Candida albicans
QLIMTLNKTYNDNDRSHSTINIKDTFESDLHKNNNNISTDSIRPTIFELTSNELKTKNDNTGVKMVVLGDGKFHTV

SEQ ID NO: 21784 - protein, 187 aa, Candida albicans
IDSPITPSNAVNMNNGSSLFNTLDVPNEEDERRRIEPSVSSHPPQPPPPIESTKNKTPNTDLVESVIEQGYMTVLKKKYNRNLTKRVYLVLTNVNLKVYKTQEDYRTDSQQQQKQPFELIYKNYPINDILDIIELDPMTSKYQWCLLIITPLKRIRFCCHDEEDMMKWFSALKAVVVTQKKKQKEIT

SEQ ID NO: 21785 - protein, 81 aa, Candida albicans
YDKLYGAYFKNPPITIEGSKYLTYFLGAYFLMAIQGKANKNPIKKHHANTGYNPLKTFLGPITPHNTDAEKNVLPPGHVNF

SEQ ID NO: 21786 - protein, 123 aa, Candida albicans
IRELIGVVVISSIYTGYLTPVTCIIDIGENNNEVGYSTKTENRIIVGFKIMNKYREDAEDDDGCENYSINFNKRHERLHIFSAFGLFVCCQLRMFVFSHARSRHLVQQLTTVPHLKFLKLIQH

SEQ ID NO: 21787 - protein, 90 aa, Candida albicans
PSSLQKNNACVRETTLLLKTIGAEDPWGACAAALFFSVYLPMLMDVFGESRRIIGEKYSPDDVDEWSINGVNLTEKNPSLSNPPFASSST

SEQ ID NO: 21788 - protein, 65 aa, Candida albicans
  UNSURE (55),(61): Identity of amino acid sequences at the above locations are unknown.
SLFSAITHSLVFLLSLLISFCHLPQFNSFLIMKSDDMTPTFKSFISASILSLYDXHQLGAXIIPI

SEQ ID NO: 21789 - protein, 67 aa, Candida albicans
RKIIINSNSKEQLNEVWQVLNFWGVEKSIIIIIIIFVNIGNSRKSKKEEKKEGNRKKERKIRIKSEN

SEQ ID NO: 21790 - protein, 112 aa, Candida albicans
FLHPPEVQYLPHFIQLFLTITINYYLPLTQLDHTLSDLIRRIYFTESIKSVSTTMSVAITSNNNKQPQPQPQPHLKVVNNNSTFNLYTWLRSVFQYCISLIISYTSNWLFIE

SEQ ID NO: 21791 - protein, 92 aa, Candida albicans
KYFLIFLCHAHTTHYTNQYNFQFFFFILLFIHSSLLLLISPPLPTHQPTIISLLSNLKLPTHSLLLSFLIIYIYNTILVTTTTTTTYYYFKQ

SEQ ID NO: 21792 - protein, 100 aa, Candida albicans
IRKTGKLKLKKNPQLFLKEQLLRRDWSIKSIVLFMEKKKKIDFITKSIMNQINLLIQENNIVVVVTFYQFMKQMIGLIWGEGGDGMEWNERGYNINYCLK

SEQ ID NO: 21793 - protein, 97 aa, Candida albicans
  UNSURE (16): Identity of amino acid sequences at the above locations are unknown.
SIFVGAKKGQVSMLYXILREDENIVGIVDQKKNISSLFKVTNQSYFAELIGNYQDIFESELDQKPPLRGSWDPKIEVVPHISPPATAQYPLSVPEQE

SEQ ID NO: 21794 - protein, 82 aa, Candida albicans
YILYYVVYYKFNNFSLFFYMFVIYKLSSSQCLNIHNIKNDFLIIFIHLSKSGIKFLIIIHLQFLNKLFNNGKYINCIQWSGT

SEQ ID NO: 21795 - protein, 188 aa, Candida albicans
LLSRHLIIFRMSDNTTSNQSSTGDSKSTPGAVPSSTDGSSSAPIGNSVNSVDQTSVSTDKQHGNQNVPQSSGAYSGQNYNANYQGYGNNPNYNNNYNNNNNNNPNYYHKNQYNKNYTGGNSGGSGGRQNNYNNNANQNNNQRYNNNKKQYNNQKMNHHHHNQQQPQHQYVNYPYKTAAAATFTKCMGY

SEQ ID NO: 21796 - protein, 106 aa, Candida albicans
YLSCGACCLDISSCSCCLRNFSFNLILSSNDNPLNLLLSIDSNFSLNLNLDESFFKSEKFNDRFFILVGDELADRGLMILLGEVFKNDTGEDGNEDEHNSNVASVV

SEQ ID NO: 21797 - protein, 91 aa, Candida albicans
RKQRKKILSITYIYASTSSSSLNAISAALEFIKKYFKTYSIAKVTTKSNIMHPVNLVLKSIVIGTNCITSFNSGINSVEQENVNPATPNNP

SEQ ID NO: 21798 - protein, 71 aa, Candida albicans
STQKNVSIFPIQKITMYYTQKKSHTKKMLVFFPYKKLLCSAHTKKSHTKKLPYKKFTMYSHIQKITIQKKC

SEQ ID NO: 21799 - protein, 69 aa, Candida albicans
CFFYTHKKILCNPRKKITSIFYHTKNYYVLHAHKKLPYKKMLVFFPYKNYYVVHSYKKLLCSALIQKIY

SEQ ID NO: 21800 - protein, 61 aa, Candida albicans
YFLPYKKLLVFFPYKKITIQKIAIQKNHLTKLLLYKITLYFVHCTDKGVYSMAAGEELRII

SEQ ID NO: 21801 - protein, 84 aa, Candida albicans
CFSHTKNYYVVHTQKNHIQKNYHTKNLLCILTYKKLPYKKNVSVFSTHTKKYYVIHAKKLLVFFTIQKITMYYTHTKNCHTKKC

SEQ ID NO: 21802 - protein, 386 aa, Candida albicans
  UNSURE (46): Identity of amino acid sequences at the above locations are unknown.
NESQLYPLHLSIIQLNFNLLKSHYLMLINNNILGQITKLENDYQSXINFPSSIEDFKTSDNKLLIDMKGSESKVKHCAKQLKKILPNNYEFKVTFNPNKFNDTFVINKQDFENQIVIPFKILSGIEIIANETPIESNSNTTTTTTTNEQYHQFILSYFNENEQQDNINLDKAIVSLTLFLRERGFLINEKREMEFNPLIEPVVSSSPVKLQQSLFNPISPLPLQSITNFIDMRTATPQKGSVSPKKNSGQLQLPVKLQFLPNKSNNHNNRGGRQHQRNQSLCLPVKQQQVYYVLPVKQQQAYYVLPTKQQQQQQQGYYLPTKQQQFLPSKMQQYQYQQQYQYSPIKQPNFQQFYIPSPTETLVPTTPTTTRTRSTANTMTPYIYSI

SEQ ID NO: 21803 - protein, 60 aa, Candida albicans
KTFGRKKDTETEKSNLSKIEKKKQTPIPPNKIIPFPLLPLPKYFWLNQNQHYYLHYLAKL

SEQ ID NO: 21804 - protein, 101 aa, Candida albicans
ADKLAEEGGGCDSIFRDIVLQPRVLDIYCQLLMQFNNTLRKSCILAIEAGYVIMVSSLFLKDLEDSFIKSNSVKSRIFIDNSASVLQSELSSSFQPCRSKI

SEQ ID NO: 21805 - protein, 80 aa, Candida albicans
SLSTCLARSCYYSKYGTEVVQNTSTDTHIYTQIYIFGYNCFATKINHKLKRPKETDNTMSLNTCKQSPNTFGILNNFITT

SEQ ID NO: 21806 - protein, 89 aa, Candida albicans
KVLSSSNPLVGITKDKTRRPYFAKKFRVTTIAPIHLKQKNIYFNRSASLERVDKFLKSILYCLLLFPHHLTQIADTHTHTYILESSPTE

SEQ ID NO: 21807 - protein, 277 aa, Candida albicans
ETHINIPMDGFLIDACFIEPNATVQTDMLFTLIFTETRRLTINLFLWSNVEGVWQGFSREVLPLENDTEIPVFVAPLTNNCSFLFVSPTKLTIVTIHDIISASYDFKTIEAPWQKSFPTTYHIPKENTSPIEIAKFDEVLISTDTGAIYSIQVIENSFGKCDPIIRVADSISHFVLEKRKENYRMIYASTGGSSKDILIPGLFSSEVLADISNMSKIPYTNAKLLNDFKPWAPLVDVSIIDSKHIKDSKLPLRNEIWGVGGIGRKRDLSQFCFDSSP

SEQ ID NO: 21808 - protein, 170 aa, Candida albicans
  UNSURE (12): Identity of amino acid sequences at the above locations are unknown.
GGPLFPHLRPLXASCENKKGGVGNGGKGGMNKGGKGGKQIEEQCLEEEYSTEEEECDEFNNGKGNAGKGGKGGKGGKGGKGGKGSIWKAKRDEDEFTAAIDIGKWKAKLGGMKGGMNKGGGKGGMGKGGQGGMNKSGKGGKVKQPVEEECLEEEYSTEEEECDEFNKGKG

SEQ ID NO: 21809 - protein, 134 aa, Candida albicans
PFTLGLTVKNMDFNLLHRKYLDKIKASVFKKQQELLLPDVHQRRQPDNDLSLVPITSPPDDPHQYPSTFFLSPVTSNESYNYYSDQSLSKRQYYAEPQSPASSVDDGETEKEDNEDVISDAPEDQDVVMTTESD

SEQ ID NO: 21810 - protein, 94 aa, Candida albicans
ILRYTRTIKPTLIRYSLVRLRCEPGKNKDNNNLWKPVVDQECTTLEVGHRIVYKHSISNEETRFVVQFSWRAQYWVSPPSVCLAFYFFSPYGKH

SEQ ID NO: 21811 - protein, 75 aa, Candida albicans
GPPLNKEQQLMTITVIEISQLSLKEIFPLFWGEEERLSFLMVFQLKLVVVVELFIYYKRRITQDLPQIIIPINNR

SEQ ID NO: 21812 - protein, 66 aa, Candida albicans
QPGGAANEHKSEASPDHSLLTRWRPFAVATTCSTNVTIVTKLQKILVCTTKGTTIMNWQNIHKQPT

SEQ ID NO: 21813 - protein, 65 aa, Candida albicans
SNFVISSNDNTRPKNPKNSNAVPQVQDTLNHQYRDLIHIKQVMTKVIAKITKNRILATRFNFGIA

SEQ ID NO: 21814 - protein, 60 aa, Candida albicans
VIGCAAGCAAGAAAGAAALLPVNPEKRSPKKLLLSISFALVNAATVSNTELTAVTFMIEL

SEQ ID NO: 21815 - protein, 91 aa, Candida albicans
RMIESLLQKKQKRSPENFFTLQQIGRYIFANLQQYSTTQLGNYFAPKKKENKFFFSIPNTVINLIASPNTVIHTKTTRGATTPNLSVLLTY

SEQ ID NO: 21816 - protein, 296 aa, Candida albicans
KNFLEISFVSFEANFQSFVTNYSSIMKVTAVSSVLLTVAALTNANEIDKRSFFGDLFSGLTGSKAAAPAAAPAAQPAAQPITQSPADQPTVQSPVSSDQPSTAQPVAQNNLLLDSSNSTLVVPSSSKSSTTTRSTAGLLDNLLGGSGATSSEASSSEAPSSEAPSSEAPSSEAPSSSSSEALFSSSTTKRPTAADKGFFGDLFGTQSSASETDDEDCVEETESPTSAPASAPTTSKVATTTGGGLPNILSDLFPGKSSAPISSAESSPTVASSTTGFPNILSDLFPWQIECSKFQS

SEQ ID NO: 21817 - protein, 158 aa, Candida albicans
MIRMRNLMMKKIKPFFEREDKMRNLLNDMGGIVISEQFGREISKKFGRIWKLEETIKLFITVAKAVKEVGLFVEESDNDDEVEEESRNSAPVNEEADRTIFESGEVDTQQDLSDNTSNTSDMESETETTKRSFVEDPEEILHVQPKRKRLVISDDEEE

SEQ ID NO: 21818 - protein, 201 aa, Candida albicans
LLVYSPFSLKMIHYLIFPILLIFFQIIKSSGYYVPANGDDWTILKPPSCKNKLPGQYIDSLPFTFGIVVNPYILNEDGDYEKPIVSKIKPSLTTTTFVTSIITTSTATAPGSKPTKTKDIIVQIHDGQVQKMKHKHDYSSGGGDDDDDDEDCFDEKNIDMAAKRDYQDMNTQEQANEDSGQVLAESDSHQQVVDQNEQINE

SEQ ID NO: 21819 - protein, 191 aa, Candida albicans
IVPFLCNLNPTMNVTIEESGILRSLGVNNLILLSIPIAAILVYLSYLQKPKPKVNSNKNTNTNTNTSKDYKIADRPLGYWKPDYSFKTPTPPPFPNWDFEKTRPIPYRAFRHKYNVTMGIRSMNWDSWIELHNEWKFYHDLKLKRLQEKESELSGMSDLAQDASWELLQELCQYLPARYPTMFKFENGIMN

SEQ ID NO: 21820 - protein, 83 aa, Candida albicans
RTIQQNLHLYTYIGAYIYIYIVLLVTIHRESLSQIKLYELGLSIRLVLLYSLSVIIIIKIILAFYFSPLPSYHFSVSGKNLQP

SEQ ID NO: 21821 - protein, 61 aa, Candida albicans
YHCKEAFTRGGNTLISHFIVNMTGEKKSKLDEKLIDDCCNIIFHTFSIILFFNKSIQFLTN

SEQ ID NO: 21822 - protein, 110 aa, Candida albicans
RRDLLRRLVKIFKLVYWLHLKQERILTFSFHSSFFKIVPHPLKLSTSRSSKYKRNMPLKKKRGNINFVFTSMSLSSSNSIVKEKDVYYQTKYCFSAYIISRVHIFLFFQI

SEQ ID NO: 21823 - protein, 80 aa, Candida albicans
FHNTWLLEHVVFLWMTLTYPNTAYLMKKNQNMGGRSERAHYWLFQIKDLDLLVLIAPIHREIGFMVGDEEISEIILFPLP

SEQ ID NO: 21824 - protein, 75 aa, Candida albicans
KMIKKINRKRKATHCNVFYSKIRSIIKRCLCMGLEQSNSYQRGEAPLTLQPHGKLKWLVLIEGFYLSIKQKKNSH

SEQ ID NO: 21825 - protein, 70 aa, Candida albicans
IAQHVTSANSISTIFCRALKKMHAKFEHDKKKPQQLIPTNQCWKKIRHQIEYPHQIQMHLFVVLGLGRHC

SEQ ID NO: 21826 - protein, 230 aa, Candida albicans
HFVEFSYFPSNSISLCIMSNTVVLNLDYTFVIDPKYNNNEIITCYETHNGIWRQYTSKSLSSSFSSSSSNTGYKMIDNLYPLQQLAQTINDNAQGSNNRVKVLDPSIKNPLIMVSIQGDETFINDARHQILINYNRVGYKTLTLNEIEFMNINETFTDEMMKLCQRYEVEIIINNDINSFGGGDGGKQKSATTRKLEEEQIYSIHIVGKLDNITFCAACLPPRELAYHEQ

SEQ ID NO: 21827 - protein, 70 aa, Candida albicans
EVVAVVVVGCGSTQLLSFMNKYEKVTARLGKEPNKTKGKKGRRRTKALDARIDHKKKDNQSGVCCCCCCV

SEQ ID NO: 21828 - protein, 79 aa, Candida albicans
VYFSTVQFIFNLQYPLYYSNLLTIAATSKNIVYDSLIEKKRKSLNSETCFAMYVCIVHNYNCSGVICLFLHRPGAGRSN

SEQ ID NO: 21829 - protein, 66 aa, Candida albicans
FESYYMIFDFFKPKPNHYTMGFINELIKALKLFPQTSKQLLDKFITTYFFLQIPGYMVPTESWITY

SEQ ID NO: 21830 - protein, 101 aa, Candida albicans
YSILSILNRSNRLCVHKNEMYTKKEQLKNKIKFENRNNKRRILIHIKQEGQYSSQVIDTYIHGTIVLGIKVSTKQQISIIHFAWAEFSKSSLFFYVTFLGI

SEQ ID NO: 21831 - protein, 65 aa, Candida albicans
WAGREERWWDNKIIFFLKLDGTGGINLKARFNKEISSTYLKQLAQRMKSCGLNVNRCLCKDTCIF

SEQ ID NO: 21832 - protein, 262 aa, Candida albicans
TWIFQPVANTSSFSENFFNNSVPIFDSLRLKIIHDLLIDHNLTLSNINGLFEKFEFVNQKTSTIDTTSNNTTTKDLVNDLNNSFLSKLHLDELINKLSNLTINLKYFQKYNNSIKNFHNIDEHQDKLLIFNQFKQDLNNIKSLYKSSLIDLNHEIDNNPQNFILPGPGSPTNTTTTTTTTTISSPTNSNGNRFSLKEFSIKKRSSITTPTPPLTTTHSSNGNGNGNVNVNVNSKRFSGAFTVIQPNRFSLITNISEIEDFNI

SEQ ID NO: 21833 - protein, 91 aa, Candida albicans
TRTSTRGEHSLTEVMIHESLKLEQAKLQETERKTLVEIQQEQEFAKWWEEESKRVQEEMQRLEVADTKKKKKKKNTSPKPQKYRKPIKSDS

SEQ ID NO: 21834 - protein, 60 aa, Candida albicans
KFIIVSSSPVNASPLGQHQQIIEQQVEKEPSYRIENPELTKAIINQLSILLTTADHESSP

SEQ ID NO: 21835 - protein, 68 aa, Candida albicans
VSSGQKKRNGKSKKKKKFYCEVKGVVYMLTIKYLHMNRCVYATQSSLATSSLIVSTLQCRLMKYRKRK

SEQ ID NO: 21836 - protein, 385 aa, Candida albicans
LSGRLLSDYASCPTGEDEEQGWDEEDLMKKTLMKIFTMTAKSNHLNTTKEDFSDGTDDTIQDLPIDFYNEDGADADDVEIAYVDSDGNEFIIDNEDLEEAILDEAILEELEANGRVHDLNNEIVEYYDENDGLSSSDSESSSESDLEIDSLNDSSDSSDSSDDSDSSESDSSDDGDSSDSSDDSGVESLDSDVEQEIKDDLLLELIKREFEEELVSSDELTSEDESSDLGSEPEYFEVDTEDEENSEDEGITIYKSLVLPEDIDDEDVVFYDDLGEESDNETTDNTKLLANDSDDEFQVVDLTEDLENSLDYKLEEIDANTYKLNVRFPSLVKDELKIDFLKNENELVIRGKLNLNDADIDEEVDEVTANVFTTGTADPRDGGAA

SEQ ID NO: 21837 - protein, 109 aa, Candida albicans
VCRSTSAAAVDENFVGTYHFELPFQLPDSSRFLFKYHPIFICPVSREQLIPITENGYTTQAVVLNYCQHLVLRDSIWHLSKKGIDIFKCHYCYKKHKYSDVTDAYFIDL

SEQ ID NO: 21838 - protein, 118 aa, Candida albicans
HELLDQRRRRRRNFFSVITCTTFKSIDNSKILNNNTTQLILFLSLSLSVKKKKKEKDNKEIKQSIKQLNKVKTGTFTIQVQIEREREIERKKKNLVQIGILSYLISILYILSSYTNNI

SEQ ID NO: 21839 - protein, 75 aa, Candida albicans
TQRDNSLKTVQQNTAVGADKLKPLDVYDGMYKEQVQPQRLVSEKFKREAEKNIKLYNKVVQSRLDRKLLENYLGL

SEQ ID NO: 21840 - protein, 68 aa, Candida albicans
FNKLFPNSNQMKFCFAEGCCFFFFLYNFNNYHSFIGYLYICLNFFHTTTTTTSTPTTSFSLYNNAFIN

SEQ ID NO: 21841 - protein, 60 aa, Candida albicans
  UNSURE (41): Identity of amino acid sequences at the above locations are unknown.
IANKQRIERKGYTLLLLGNLNFSIVNKGALQCPLRNGRPRXKCTGREGGVEVVREVYVRV

SEQ ID NO: 21842 - protein, 98 aa, Candida albicans
QYPILELMLNTFAKIKPDILKFKTSISKYRNINTKMVINVINFEKFFKSELVAMLENKASKIPLKARNGRYTTYRGKSLNMSVLSQFEALPPIKSFSK

SEQ ID NO: 21843 - protein, 91 aa, Candida albicans
LYLTRKLKTITQSQVGNYNIKRTFQSRCYKRFATNIYVRLTSQDTYRGVKNWRLNSNQTISNIIKLKKKAVLHITYIHDIYNKNIHILPKT

SEQ ID NO: 21844 - protein, 129 aa, Candida albicans
QFSREIRRPCPMQDTREEEEGQEKHGLSFHQTQNNSVQIIDSWLRNDIKKKDKKKRKKKKPDIQSCLRMLTNDQKLNLELIRLGAVIPSFLCNQSEIIMSLVKYVCFYYKCHVCMLYVIQLFFSVLLYY

SEQ ID NO: 21845 - protein, 495 aa, Candida albicans
  UNSURE (24): Identity of amino acid sequences at the above locations are unknown.
DSNQLTINYLSELVYRKISQLVEXSIVFCEVWQDFLILIVEDTDKQVKIKIYRIVFSEVSPTLEGDTDTDIFKYFELTCEQVLDFQPSMLKACTVKDEELTIAIGGFDGNLHFILFKDGELTILKTHDLIQFSNYSHDEITELSFIIPHDMIVTESEIIIGTQEGYYLKFDIVNGVKNNLQCKQFLRIGSTSVRLCPTSDVKLLLVYSDQLWLLNKYESEYPKRVYFDDNFERSILQSVEIKNTKNNSKWKSLALIRDNGLVLVDVSSFCQPSIRQLSMPDNAKKLIYIPHVSTFLVLYHSNYANSRIKCVDKKSIKVVPHRETNIKYRLTSNMNGGDNETYIFQDDEIPISVCIWEVQRNGSKKSMTTKKILIGCEKRSFDNSCKTTGVVKVLDLKKIRSNSEHNNNNSPDDNFPGVLITELTSLDHDSPVTNILQCNQNIIFTSEGNLYPTSYYELEKRFTPVKSCQTLPSRIISLYVSPSSPQEKFMSVYQP

SEQ ID NO: 21846 - protein, 93 aa, Candida albicans
RLDLTTLIPIIVAAITSALPGVLNTILGLLGDLPSPIDPTEILNVSSSTNTTSNLDLVNEIVNQVKVKLPQAISEFEQNSQNSKRIGLDSIAQ

SEQ ID NO: 21847 - protein, 65 aa, Candida albicans
KYLERARWASWIHLLYTKVSEAFHQPKIYYSEESCIVSIESSSPTFFFSLISQIFLAEALILQQK

SEQ ID NO: 21848 - protein, 69 aa, Candida albicans
RERKKEKRRGVEEKERKEEEKEKGERGKRRKKEEDKEKEKMEKKERKRIKRRKIEKREKKRERKGRKKG

SEQ ID NO: 21849 - protein, 86 aa, Candida albicans
RKRENGEKREKKDKEKKDRKKGKKKRKKREKEGVGRKKKTKSVTPPRQPIQLLLLLWMIKMYNHVHHMEHRHHHQILKTWNHQLRV

SEQ ID NO: 21850 - protein, 61 aa, Candida albicans
HCSHPLIVFLPCESKWYTINPNKIKRREDNQERSVRRLLKIENPHQKKNIQLNTNSINKYN

SEQ ID NO: 21851 - protein, 101 aa, Candida albicans
VCWHREDIRPSTSNGDQSNRDTNTPTTSTSASTTAPPPPPPPPQQQQQQQPSSSITTTDNNNNNQTSQQSQEKKEKIIPRDVRLLHLIYATHAVHNYQDHV

SEQ ID NO: 21852 - protein, 62 aa, Candida albicans
ITTIWSIVRLQKILISHLNKPPFLSSFLSPPLRKASIIYNDTSNSEYVQKKEVASLIPFLAF

SEQ ID NO: 21853 - protein, 64 aa, Candida albicans
PVYMMVFVLYFNCLQRLNLLEIQRMINYSFVLTLFFLFYSIMFFSFLIFFFLFIQSRAYICPKA

SEQ ID NO: 21854 - protein, 75 aa, Candida albicans
ALAFLQLQKLFLFFYLFNILFISSLSINSGLFVNFLGLLLYSDFQVLEIFVDNLKDIFKGPCPFPPNHHFTPFLI

SEQ ID NO: 21855 - protein, 187 aa, Candida albicans
SDGPSLVTSVESNTELISSATQSSDIQTEFTSTWTTTNSDGSVVTESGIISQSGTSLTTLTTFQPATSLVVPPYSVIETEFTSTWTTTNSYSSVATESGVVSQSDTLLTTVTTFPPAPSAIVPEFTSPWKINTSIESTETLTVSASSYETLGESLAAATSSYLSSATVVVAPSESEINTISSILNNE

SEQ ID NO: 21856 - protein, 145 aa, Candida albicans
QFCYLCLKRFLVHYYCGRSEKNISTVGNNVSSIVGDDVSNTQAITMATSTEGATTLTSVSGAKPSVANDATNSVHTTDYTTATAGVQNGSSLSIPSDVPIEISVITPTNSSSSAITIPYENGSNKELIENIKYLALVVFGLMMFM

SEQ ID NO: 21857 - protein, 85 aa, Candida albicans
LIYSAIQQQQTKITNKKFVEVIIYIDHINIINPKTTNAKYLIFSISSLLDPFSYGMVIAEEEELVGVMTEISMGTSDGIDKLEPF

SEQ ID NO: 21858 - protein, 138 aa, Candida albicans
NFCNKLIHLLVTLKHSNIIARNKNIIPHSPSRSLSYNLNTHPPLSTTTKCYDKNYYLTLKNSQSMYIHNIVFLRNDHYFSFSLGCGLFVSVYDPLKVLQSCGKQYYVRYHHKNNLSQIVEFWIAKPFVDTLEERLEKA

SEQ ID NO: 21859 - protein, 109 aa, Candida albicans
YTANIIIVGKTPCNTAPSTLNTSPANHNTINVNDKPSSDFLLKFSYIWGAKTIIQQAIDMEPVIPLTDWESSTIGAGGGAIIVKAMSKMIYKKRKENGKKNERKKIEMK

SEQ ID NO: 21860 - protein, 416 aa, Candida albicans
RPPAIMQSSPDPLVVTSGATALSESLSMNRKHNDNLSDTGKTCRFCKKQFSQRGSLIRHLDLKKGDLLHPSNEVTIIRNQNRRRNSSVDVNFSSIEKSESQSGGNTPLMTSESFNGTNTNSKLGKKRRVLKKSLAISQISCDSASGQREKSKLRRKLRDRRIKAKLLTNDWFQDLFAQKPLPKFDNLDGNGNNNSLITAEIFCQLVALYLPINDWPVKIPDETCLTPTIERMRVRETHNLINLLNKSFLVYQKLTTVQKKQLWINESQRILQASIGSFSLCDLHNIKGVIAKREQANFEEICRNDKLSAFVEVENSPNHHGGVLGVDDEREADIEEEVDEDDDDEVNSTQVEKVKLITPQKRKTQSILGQVQLNTQQNPANLHNSSRIHGEPYIQKIPEVQHNNFEDFGTYFDKFY

SEQ ID NO: 21861 - protein, 62 aa, Candida albicans
VYVDFNGPMKPKKFIPGCFGPTQLIYLVLFAIFFQIVNNYTKQFFQQLNQVNRSLRGKLLGK

SEQ ID NO: 21862 - protein, 386 aa, Candida albicans
  UNSURE (376),(380),(382): Identity of amino acid sequences at the above locations are unknown.
RQEIEESISSQKLLQLNQSSLLTTFISIHSNIHNKLLYISEIIPNDMNPQFEINLPYVPPNIYKCVIKLWCQTNSDWKLLCLYKLNLRKMISVDNDLEILDLYKTNTLSLQLNDQWFTFQDMLNKSIVDKNPNVLPQPIQSYTFDSIRCLNNLSNSLQELAISKHNLMQQIKLYIGNLQDYKNINNINVVLNKLQFQVHKLKHDVNKLTLQNEQLNNKIYNIKQKINDLHNIIESFNTNTKEIIENKLELYDTEIQNMQVLQLSLQQQLNKYLKTNMKSIEFVFPIDNIDSTKFSILGFQFPQDHQELLAICYYNKSSIELKNLYYQPEFDSETQWHNFKIQQINAALSIIVQLMVLIADITNTDYKYKMVLSENXTPTXLXNPTL

SEQ ID NO: 21863 - protein, 245 aa, Candida albicans
INIYIHIFMAMSELLKRYQQSRKEATDTSKSRLPSIKTDPIYPSYSNLDGIRNQSRYQSRTYGGISKPTKKTSLLNTSPIYKKYESLNLPSSSQIYKREIEKKPRFTINDKNEESIFSKITKYFQHGEENEEKPERVDIADKYLNDDRDEVDELILRVKELEKKYERERLKKLEEDNKRIQNELDDIKLENRKLKDQIERMEIRNRKELNQLDKKLFELENKLIMETQTTRRSNNYRRSTYSKDD

SEQ ID NO: 21864 - protein, 63 aa, Candida albicans
GKAVIAFDRRISYEIQILFELGYVTWLIMNSPHCIMVDNVTEENNTLIYFLVRKYVDLSVRPL

SEQ ID NO: 21865 - protein, 118 aa, Candida albicans
LLYNCIELIRCLKKNTVKPTTTFSDSVLYHLKKSNLHGYSAPRCALNAWENNINNNVKLRHHHRTYKSKLKCTPIRRKSHFNLLIAKQPTQVTPWYFSLFFFYWISYQYVSRVTKNEN

SEQ ID NO: 21866 - protein, 103 aa, Candida albicans
SPTFELDFYLIFIHILKLTHIFIMAGTLFPDKQFEKFNVAREKMGHYFRFKPRSVFFNIIWMGIIPVGLFYVAYGNEGKVSITDRFRKKPILAKDYVPRSKQE

SEQ ID NO: 21867 - protein, 70 aa, Candida albicans
ELITKNKAEKIDNLFVSMAGNSVLIMPAQLVKHQNTVDMSERFGLNDTRQEKSSRTKTGCWDLPGKKRQY

SEQ ID NO: 21868 - protein, 69 aa, Candida albicans
MSRDRTTIKLSPATPPQSIITCAFFRKLAHVCVIKNLTLILQINQLKTRLYFLVKAQQKKINKKANIII

SEQ ID NO: 21869 - protein, 64 aa, Candida albicans
IALCNTDLTFVKSEIVDHLLPCINPIDYLYQSDNKTFSSIPDTFNFHDDNAWKIQKLLKNNNKS

SEQ ID NO: 21870 - protein, 78 aa, Candida albicans
SSDCNSGSLHYQLVISIAYKKPGTIRYSNIYRLKFFNMVQAYNMYASFNNNNLAFIIIFQQFLNFPGVVIMEIECIRN

SEQ ID NO: 21871 - protein, 62 aa, Candida albicans
VGRYIDLHSISTIDRMIYRRRKAKEEKRRIWVVNFFGESIDLELLLIEKEKGGGGVQKRIKK

SEQ ID NO: 21872 - protein, 73 aa, Candida albicans
SNINFVISLIKKSVIIISVAKKNKMKDEYRQDDDDDDGNANLSKHYTIAISFPKLVKCFIISSFCVYDIEQKN

SEQ ID NO: 21873 - protein, 63 aa, Candida albicans
CCFSNTVKTIFFSKKKQKKLEQRINWFTKKFSIPQISKEKMGHFTRIKFSIHNRTNMIWLWGL

SEQ ID NO: 21874 - protein, 100 aa, Candida albicans
LGSNSSLEPISSTNVSPLSTMKEINKFIINQDLENILRGIYVRNEDIYLNNINQTTILCQPIIMCNDNSIHMLFLEKFYNDNQGNVRYQNLIKVESILLQ

SEQ ID NO: 21875 - protein, 84 aa, Candida albicans
FVNKNTNLDLSSSLSSSSSSMKRNDLIEQFLRIVLTRLYPRYFGHILPIIGGGGGFGGLGGVDTIVNANHIGISNKDNVEDMTS

SEQ ID NO: 21876 - protein, 65 aa, Candida albicans
RELALIVVTIKYKQNGYCELEKMFLKLALEGPINTNFTEYGHLFKFVILLQMSTSGSIEGHKILC

SEQ ID NO: 21877 - protein, 69 aa, Candida albicans
WRLFNNWSYMIICVRIELIKNTYFNTFVTTSNSVQSPRSLQVVPYTVLKSRGLSFYFISIFFAKGCNKD

SEQ ID NO: 21878 - protein, 66 aa, Candida albicans
NEHRTKLLMLKFYSHTPIISLILCLLIFLFLPMDPKSWVFLVENKQKKVLLGILKDTRSEYIQRLL

SEQ ID NO: 21879 - protein, 92 aa, Candida albicans
DQTFFIFSFFLFLDDNSEKSFYPHSIISLKEPHHTHIYYLLLLFLLIESIKQHSIFFPIYKNLAKSKYLLNCYHGRTEKEIINQPWQIHLPH

SEQ ID NO: 21880 - protein, 61 aa, Candida albicans
HIHQYIIIKEDPLQHNTISKGSKSKREPKREKVKNQNIQNIQKLRSNFFYFFFLSLFGRQQ

SEQ ID NO: 21881 - protein, 64 aa, Candida albicans
  UNSURE (8),(16): Identity of amino acid sequences at the above locations are unknown.
DIGFFIWXWGKLQKSXWVVQFHQIRGLSNISNEENFEKEERKPQPQQQRQPKAKTTSRTLLNST

SEQ ID NO: 21882 - protein, 83 aa, Candida albicans
INNVLISLIPLPQLLKQGYRLSLTVVTEYHQQHTVNDTLIDDSIDNNDISNSNSRNFPPSSPTKQAMVQHKAQTRDHNINTHK

SEQ ID NO: 21883 - protein, 392 aa, Candida albicans
QPIDPLQQQQQQQQLNDKIVVPPVPSSSPLPPSSPIGNKKRPHDQKHSPNTWKFHGGNIPKRRKLTRAALATTGNIHTNSGNNFNDQLTSSKSSMNLPLKKYNNIDTTTITTNNNNNNGVKQSKGVNQLPLPKNNYQLNPSKSTPIIITTTTTTHNHHNLSEDIDHYGHSRLKNLRKPSIPSMATPLIPSSSSGSGSGSGITTHQVSKPQQQKQINEIQDQANDHDTSVDIVPETIDNNNNNNNDDDFINDEFDYDPIDSVEPEINSSKEEEVKEQDVDNEVVKKKVLSKKVVDSDAENNDDDHDDTTVIIQANEDLKSKKHRQVKKTPRKKEVLMILSPRDKRMQQRQQRQEQQKQKLQQKQKLLQESVSPQIQSVDDQLLEEPSELRVNR

SEQ ID NO: 21884 - protein, 123 aa, Candida albicans
PRKRESDITSENNIKRRLFDADNKNKREGAHVFYMTQSYQCDTKCHYCLRHTTLLSRMKVAGLKKDIHLTGKAGSIEISIVSILIVVFDLLIYSTFGIIKCSNLAFRFISLLTSLMIVFMETN

SEQ ID NO: 21885 - protein, 162 aa, Candida albicans
RKVTSSSEVSSSSEVSSSSEVSSSSEVSSSSQVTSSSEVVSSSSEVNSSSSEVVSSSSEVVSSSSASSEVVSSSTECISSSSEAISSSSQVTSSSTECISSSSEVISSSEVTSCSSEVVSSSETCISSKEMSSSEQISSSESTSSCSEFVSKSSEHSSLSSE

SEQ ID NO: 21886 - protein, 70 aa, Candida albicans
SYNSAGKSSGLIMKQPENLRKNQTLSFLMEPMQTLWGKDFTHVQQFNDKVQFLEAIGIMRHVHVRVFLLW

SEQ ID NO: 21887 - protein, 82 aa, Candida albicans
KDGDRYRDGDILTYILISFRCRELLTVNHNGLLLLLLLLLLLLLLFLSIDHLRPSLTFHQIKNKNKNKNKNKNKNKNKNKNK

SEQ ID NO: 21888 - protein, 73 aa, Candida albicans
VSFSFRIFCFVSKVYEPNRMGRSRQLIFKVQVIKENIITEDCQEYTGPLINLKRRRQIQRWRYTHIYTNFLSL

SEQ ID NO: 21889 - protein, 65 aa, Candida albicans
LHTYITFTNHHLIIFYYYMCVHTLILPIYYSWDNTLLLMLKKNKEKNFFLNISNIMRLGCNTSSL

SEQ ID NO: 21890 - protein, 175 aa, Candida albicans
KIFKHNFNDVSKKRFEATWKELTAATDLAITIPISDIEDIDEAEEEEDEQSEEDASESTPQASDEAPKISGQAALFNNDKEINPNELITLRKRNVRPNKKNNNNNKKVPQEDQKEIDYANADKILLKDTKKKNDRKRRGFDPYSRDSEGPKPAKRAKAMTSGRTSTYKKKMNKYK

SEQ ID NO: 21891 - protein, 81 aa, Candida albicans
  UNSURE (68): Identity of amino acid sequences at the above locations are unknown.
KKKNANATFNIQVIERERRRLELLDILGLIDDDVDHSGDSIIIIIITTSFWYNKLGEQIMKEESDHNXMTNLPLFFFINFC

SEQ ID NO: 21892 - protein, 124 aa, Candida albicans
QICLFFFLSTFVSKKNILLCYHFCTCFSCFKLLFLNNNNNNNNNNNNNNNNNNNNNNNNNNNNNNNNNNNNNNNNNNNNNNNNNNNIVIIFYFYFCFTCISRFGSSNESGGGLRWWWWRASEIL

SEQ ID NO: 21893 - protein, 60 aa, Candida albicans
  UNSURE (22): Identity of amino acid sequences at the above locations are unknown.
QRRMFFLLTKVDKKKKRQICHXIMITLLLHNLFSKFIIPERRGNNNNNNRITAMVNIIIN

SEQ ID NO: 21894 - protein, 176 aa, Candida albicans
VSPFQGQIDTFWCITTTWMFISHLQKFFFQKMIGGVYDAQVLTDETIKETIEINNLLSTRAVPQIPVFLFHSKFNEMSPFLEILKLEKLWCSQLGVNLEIAEDMSYNHMVEAFSGMPAAITWIEKRWNNSTLGGCKHVHRLSNFEYPGIAPFLSQYFRSSLQMVLNNNRYFNNTTR

SEQ ID NO: 21895 - protein, 153 aa, Candida albicans
TIFLPVYVTLSGDWKLMGFELLTNLTSDPDQPIYRLSRYMPISWKEYSNDLDSETIRKDPKKFDSYRFGNFIMTVFNNGVIDTNYSKLPPKMSASVKRLLLQKPNLRSTITMYLKDLESWHKQNSVIKFTEQVNELKFLQESEKIAFFKHELP

SEQ ID NO: 21896 - protein, 95 aa, Candida albicans
  UNSURE (11),(16),(27),(30),(52),(56),(60),(68),(76): Identity of amino acid sequences at the above locations are unknown.
TSVRYEDICAXILGHXAISLMDRKLSXVRXESKRISELVLDSVESHAKLVPXREMXMKTXKDVSFSKXFLPAMFPXINTSPDNVASTGKSSLQSG

SEQ ID NO: 21897 - protein, 167 aa, Candida albicans
  UNSURE (24): Identity of amino acid sequences at the above locations are unknown.
RGFQPVVKINSQTAQGVTRSLIYXENTLQQGVNDVVSDHPSNYQKDSPKTQHLHPSNNVMLNPPESVSSGGSNLTFYTANSQPIESSSAENGQSGQPKRPYLISKPLQILSRLSSSKLSGVELSASIDSGSDHNQQEQNSFESSTTSIVELDHGDELTINLSESYNN

SEQ ID NO: 21898 - protein, 155 aa, Candida albicans
EDRNQIPSSSPITINSSPTKESTIQQPSLASKLISNEKERELEFKRQKIRQHKDFPLIRKKFNYLSESDILKAFVKCKGNARDINKYLETNFDRNEYLRKENEQRQKIIQQQEEMREKNRQLRFQQLVEQTSKSSTPEVERGIITDDVNGYRRGR

SEQ ID NO: 21899 - protein, 220 aa, Candida albicans
DSNNSLNKQVKAVPQKLNVALSLMMSMGTDEEDESPVKIKKGRATVKIDDMSPTKPNARESTKVSVKSKKSISDKYNRQSTLDKYARQFKPDQTSRLESLPKKRRLVRLSSLEDSSTPSSRSISPIPAPVGLAARFSYRESNTPNPPLDQPDVIKIGDTEEEAEPEDELEMLERKILENRKKRRQNQVQQPKQDKQNQRKPSSTKAIINLSDDENEDIDE

SEQ ID NO: 21900 - protein, 88 aa, Candida albicans
LSISFSYIYIFPLSKRSTNLIKESHTHRNQVRKKKFTKKKKRKNLETYFIFTNKNILIDIFLHESSITQPLQVTNYRYIYTSISKLNC

SEQ ID NO: 21901 - protein, 72 aa, Candida albicans
LIFPSIVLLPERLYSFCLSTNQFSINHLTNVLLLIICLCQTLNPSFSLAIQQADSESQHPLQQTPTSASFKT

SEQ ID NO: 21902 - protein, 215 aa, Candida albicans
  UNSURE (109),(215): Identity of amino acid sequences at the above locations are unknown.
LYNRQILNHSILCNKRQHQHHSKLNSYNHLHQDLPQQQQQQQQKFKKTQTKSNNNFNQSTPITPIKNASTVSSHDINQYPSSKSFNENFKPSPLLLPNLIQHSTPYVSXTPSSAKHFKPELTVLTTPITEKNLEDIYHNYDNDDYEQDFELKVNHKHNFKNINKSQTGNGEPSTLLGKEQEHLVEDIKNRMNPSNNSDEEDQADYDDKEDDDISX

SEQ ID NO: 21903 - protein, 265 aa, Candida albicans
TTSKHLTLKSSTPASTLEYSTSIPPALATTSSSLSTESTTLTTISKSSTSGSSVPNTTRESSTSTTTPNSSSSESKVSSATPKYSSSEVSSSATTLKSYSTTHSIPTTLVYSSSTSLGFSVTEFRNLTTTSKSSLSTSTTELLTSGTTVRSSTSESSVTSATSIYTSSESTTSSESTTSIETPKSIASKSSSSVTLPKSSTFAWSTSTTTPESSPITLKLSTSKPPKPSATMESSASTTKNSSIQSTSEATTSGSSGVESSVLTG

SEQ ID NO: 21904 - protein, 69 aa, Candida albicans
FTKKILRLFSIINTKLKIILTNLHHINKNSFLCNYMYGIEQFKQILLSMIVFSSTIFINPHWSNGRKEV

SEQ ID NO: 21905 - protein, 74 aa, Candida albicans
KVLAISVCLEVEEALLYTTPLPPSTFTPGDTINTHNAKSKQRGLNFVVKKKITHDPFSNAYGSSLESKKKRVYI

SEQ ID NO: 21906 - protein, 136 aa, Candida albicans
SCASEKIALCVKRLINFWCVESLVFVFYIYTLFFLLSKLLPYAFENGSCVIFFFTTKFKPLCFDFALWVLIVSPGVKVDGGSGVVYNRASSTSKQTEMANTFYIQRKKGVFKVRFKLERDSSSFFEISICGCKKVF

SEQ ID NO: 21907 - protein, 131 aa, Candida albicans
QNIISIMKIFTMFNPLSTTTTIIPLRKKTALLKNNSQNDRNIHFHLITFPNGISVEEYGLPIIKTLQDIENLPKFEVIRYLQGFDIEYNNNNVLLEIHLRNLLKDRLIIEMNYLNGGVKKTKWSKAKKLKH

SEQ ID NO: 21908 - protein, 64 aa, Candida albicans
NSFSCLMIYNHTPVNGAGSLRREREREINFSPKSINQSNRSKQQTTIIKHTKKKKKNKKFYQSF

SEQ ID NO: 21909 - protein, 343 aa, Candida albicans
  UNSURE (2): Identity of amino acid sequences at the above locations are unknown.
IXINAYSKLLDSAIAHAARESTPEVNEFEFDQQKTNINNLNNDDDDDDDDDDKVFINSIPPSKQGNNKIYTIKYLLSTRNEIQPIDVNDKLPDKSFWRLGKSRSNDGGGGGGSGGNTNSGTYKKKGRRGANYNETWERKNSTSSGSGRDRHGSDRHLGFNRSFELDQLSNDKISQLLGEQENELETPEWDDVGNFSESSNKYNNKETNNGGLMNMGQTVEDFEKWKYQMKLQERRKNGEVIDEENEELNTDTNAAAVHAGNEVDNFFSFVTQDQVNDNIDNGGIKDNETNFKQSNEQSHNDNDKPHRSSRFSSFFHQPKEIPSPATSTITTSSNRHSRPFQPP

SEQ ID NO: 21910 - protein, 78 aa, Candida albicans
LSLLCCCILQVPISSGNGFGVMVVLTWLEKKGGTIFFFLGEMSAFLLVNPEQCRSMQPKTVYKAGFAIGQKTELACRQ

SEQ ID NO: 21911 - protein, 72 aa, Candida albicans
MYLFLWLFLFLLLLLIMAKKFQLKKISTEWKSFFLLLVLFNLWCLFHNYRTYINLSLLTKLVKFLLINHNND

SEQ ID NO: 21912 - protein, 83 aa, Candida albicans
FFFLGIRSVSSFINYLILLFIIIVVIYVCDYNCFFIFTKDTSSSCIYKRRVFPSIVIYKHRNFFFLTLFFFFYNNSLNLTLFN

SEQ ID NO: 21913 - protein, 70 aa, Candida albicans
NVDISNNIRPMFGVLCVFSIAVTIRRHNHISLDSHSTHKISISPSVDNSNSRHFFSSNSSIKTLNILVTY

SEQ ID NO: 21914 - protein, 93 aa, Candida albicans
YSNYFHINDLTNFKKMSCTHTAKKEFFSFSIFQRDTEMNFALQVHFSVICIHSLSKLGRSEQYFMFQFCVLSLFNSLSKKFSTKPNCSFQRSF

SEQ ID NO: 21915 - protein, 419 aa, Candida albicans
TMSNTIPQYFIRIFNLIFLARRKNFQLALISGLLFFGSFVILSTTSYSKKFNYFDDLILKIYDYNYLTNNYNIDYLAKNDPEAYFNVKVQQIVDEKKQHDLESKFWSLDTKINDDQATLQIPAYFTYNKPRDNKNLEDSEQSSKPVEKPLIQPFDPRFTLAMYYYYIDQQMTTAHHDSSSSSSENSITVPFNWYDWVDMSVLNKYLLAPNKDKPDCSILDAHEDARKIETEKKKMDKLAKQWDENKRKAEEEKKKAEEDKKKEEEEKKKAEEEEKQRHEQEKQALEEDKKKLEEEKKKIEEEKNKLQEQQQQQQQEEKANDGNQKHSKFVKRDDEIKMLTSQDKSDSDSDRAKIDMTTFFNEAFEKLSDEDKASVAKDVEDAVKKITQPSSWCVPNAKLSIDHSDKQIVHPGFNVFKSP

SEQ ID NO: 21916 - protein, 60 aa, Candida albicans
FISCRFRSGWVGFDWSIRPQKIGLLVVDRIEKKISKFHIGLEQTNTQTSKIEIDSSVNLA

SEQ ID NO: 21917 - protein, 141 aa, Candida albicans
VFILMTNKDQEQLLQDASTLLMFASLVAKHELLNQHSPTSNMSSPPTVQQLPQQPQQPLPQQYINSGSSTRKSSEHKETSVVSSPPSVKFVDIINNPQSASVTHEKNKPTTQSKRTSISMLVNDTPSDIAGLHHGDGRIRA

SEQ ID NO: 21918 - protein, 60 aa, Candida albicans
QLNYKGYLVTHFYTQQRAIIFFLKLPHSVQYTSLQVNAFYRELEVYVNNEFIGKLHFSVA

SEQ ID NO: 21919 - protein, 324 aa, Candida albicans
IMNLSENYISASRNSSSSTATTSMSNKYSSLPKFNNHTHSNQSRIVSNNDMSTSSIFPYNRTVSSSSSIMSTPSNNIRKFQRQRQQERQHHEHLPPPSQHQRQTGSSKNEHINNSSRTSKNGRLIKNKLLNLQQSLKQQLINRISDKDPRHSHSNSSQSNAKKVTPPVFGLQKVASSPYDFSVFTTVATNEKQHDEVLFPAIKQSQIRAWESAEKICRGIIFDDDDDDDEEESTDDESEITKNPIISIPGYTEGELKELSKYPNLSSQEKKKLLAEYKRKVLSQREQNLSNNNLISFRRQLLIDQKIEILSKLFNNQNKLNLDY

SEQ ID NO: 21920 - protein, 62 aa, Candida albicans
NFPFKIVVAKPYLTNLNTLNRFANMKPEGEKKSRSLPNWVAFNIPFFFLILGHYPKELFWKC

SEQ ID NO: 21921 - protein, 63 aa, Candida albicans
VIIEQVEQGEIKSLASSIVPNGGISVSEPKQRLQILLDEEEEEKEEVNDSVSVSISVSIFDMI

SEQ ID NO: 21922 - protein, 274 aa, Candida albicans
IMSNIDTDIDTDTESFTSSFSSSSSSSKICSLCLGSDTDIPPFGTIDDAKDLISPCSTCSIITHRKCLLDWFNSVPADKLHIIRAHRQSTSRRTISINNNNNNNNNNNNNGSLNESNINHEENFDDLGVGITPTTGMDQNTTATTATTATTATTTTRIEINLSTQALLNWLSTMTAAGANTNEIEINNHHHHNNNTNNSDNNTDVTIPGGFPISRRASSSSLSNVSSPPHHGSSPNHDFKPSNEYLVYILAPCPQCKRDIIFSMSRSPLLASHS

SEQ ID NO: 21923 - protein, 65 aa, Candida albicans
LIPVECHIPCKLLFARNMLVKLLVETSLLMKGANPLSCLQLIHSCPFQNHFFFSRFSSNFNIKNK

SEQ ID NO: 21924 - protein, 78 aa, Candida albicans
TSQSPQYKLQTVCTNPSEYFIPQLYRPTMVNYRKRKIYCDALGSSKTPHISLKVLKSYSLCSLHRDKKTEHLFEIRAV

SEQ ID NO: 21925 - protein, 63 aa, Candida albicans
AKAVAHTNSTSAINMIRLIFTSGAYKERQIYYTKASHKIKPNGSGRNRGSQLQDEIAIWLLEL

SEQ ID NO: 21926 - protein, 70 aa, Candida albicans
IELISILLVKKQGNMEKKRKSGEEEKKNISCELESTILSLYIIFKWWWLAVVVCWLVMDRGGGRWTGVNY

SEQ ID NO: 21927 - protein, 341 aa, Candida albicans
  UNSURE (331): Identity of amino acid sequences at the above locations are unknown.
SMFRHHRDVSSHLNRQHDFRDDYYKIQRLINDKVHLSLKFEQLKSPEIHSTLMKPITDEILRISELSSSPLAAYLQHDTQPEIIGSSSLAVTERRDSRLGRSTYTTLDAVSRETIEGPRQKVSNNVIFILLLLRYEYLIQLENNLVCFDLLITKATVCELLSIRMLREYKSLNRVNMLFIKPLYEVDQQYNFNTLELSVLCNAQKFLSQPIIVRILERFYNGELINNESSHMTGSGMSYTDDEKGLLEADCVTDYQFRRISYKQIIKRANTVPKYQSIVINFKLIMLLIFYFLLIFGNPMGIGTLFWIIGLSFNIELITKLYNIEWQFVRXIIWNQDRFLF

SEQ ID NO: 21928 - protein, 71 aa, Candida albicans
CINIQLYCYLSSRLRNSFVWSILVLKSDEMEQVKKKNLQTKRESEKSVITFVQGTLLYNLFNFGILAQWSS

SEQ ID NO: 21929 - protein, 169 aa, Candida albicans
TIMTRLDNSQFLKQVETLTQSNNGKSSIYLTQKRLSPSLSSITTTTTAEDESINDLPTNVITPTPKTTTTTTTINNDSKYPLLIRLSMNSSDNKIKTKTKTKTDSKVQKKKERVKISTVVELDQLNEFWDQYIQILKSGFIGLKKKKDKKKSHTNNNSNSNVNNKIKKK

SEQ ID NO: 21930 - protein, 195 aa, Candida albicans
  UNSURE (8),(12),(16): Identity of amino acid sequences at the above locations are unknown.
FRQELQDXYMSXILLXQQELNYQKSLQADKLKKQKKQYDTLSTQYLIYQLDRFEKYLTKDRVANDNIAKIAIKLTNANRVTGYFPSNNSIDDIFIFVELINRGYLNVANNSTTTTTTTTTKLTSTLTESQALTKFKDFKLIYNFKLLSPLPPKICLNDVLSSSKDTTPTATTIKINQFDIIYPNGLLIVEDIQKD

SEQ ID NO: 21931 - protein, 156 aa, Candida albicans
AHSKSTDITFGAIHGGIHTTTSQNGTSRFFLSSKGNHGFGSTFSKYKSKIKFGPHQRKYKRVVNAVNGTIVLDKSKSGKDDEHGKTHLSSMMKAMEKTSVYKNASEMLQSIVNASKASFKEFLGAKPGCHGMKHHENEDGHKKMKHKMRKHLSDAH

SEQ ID NO: 21932 - protein, 115 aa, Candida albicans
FYFKHSSNRFASSFIMNDNDDKPIATTIDNKSHNPIILPVVNSIPRTQEFGVLKFGGIKDSNAIENHITWCVDGDITAFSTTKDISLCSPQANNMGSDLATSVQQSNFGRSFNLS

SEQ ID NO: 21933 - protein, 173 aa, Candida albicans
  UNSURE (11): Identity of amino acid sequences at the above locations are unknown.
HSVDPAMRREXYGLDSKISFHINANNNNNNNNHGNVYDNESNENNNTDDDDDEEEEYGDDEDGNNHLGHTESFGNNSAIHDDWHGFESATSSVIDRAFSDDDEEEVVDEEEEDVSIQRLMNSPYNNDSIELSSSEHENIIQLSGDDEDDSYYDSEDIRDAMEEMDNFNIDNTD

SEQ ID NO: 21934 - protein, 375 aa, Candida albicans
YRQKQLCGLLFDNTSQFIMEDKTKRQHSILHPLANNNQLPVKTVDTSNTADNNYNNNNSGILSSSYNPQQQHQLQQQKRPIPKNVAYPPMYSFNISTANTLKNSVSTTKATSGLPVAPDGYIYVKGYGSGSAADHIPRNIPNYYPRRGTSITNNYTESSVVTPTPLHIPRPLVPPHLLQPPNLHQLLQQPQPQQHDNGETVAAAASSPTLEIFNTLNPRKAPNMTYKEKIMNWMSSIPQFNDSENNEIYIDCYPGVISTSVTPSTSDEEIDLADIEDILELQARKVTRYVTRLYIRESENWEEIAGDDEAGDVDGGVEYEVEEGDDDDDDVDDDDYDEDRVQPHNYVYRNANLNIAYETDYSSPRGWTDPRLSNH

SEQ ID NO: 21935 - protein, 123 aa, Candida albicans
FNRKTRNQTQNKKRKNIFVSVSFISQYPPLKPFQNNIPIMSLLKRKIPLDEIEDFIAEEEEEGEQNDDGSYEEDNEFVGPSGTATPLDESEIQHVVNQVVRLFLSRELNGRTTIFTTRLEDPR

SEQ ID NO: 21936 - protein, 79 aa, Candida albicans
YCVLVRKKMTNNTANTNNINRVTDVSVCGWCRIRGLCVMCILNLEEKKNEINFNFINVEKCEKIIINYVQILRQYNSII

SEQ ID NO: 21937 - protein, 95 aa, Candida albicans
VRRNHCVAGRMFKVWIKTQESSLRVSNLEVFRRFAANCTNWRIERDEKAIYNIRLLPATFMAMSYIIQFYTTQLFMYIIIKILTSIHISQFCIYR

SEQ ID NO: 21938 - protein, 115 aa, Candida albicans
RISNIDCFRKLMAKVKVPLANDGVGSNINTFRLEHYFKNNGESLKETLLDKSNNPNVLINERSRKLSDSLLAPDLQQVGFASDHYDYSEDSYSTTIRGNARDDYGDNNEPYSFLI

SEQ ID NO: 21939 - protein, 102 aa, Candida albicans
YNQAAFKMDNLFIFDLPTHLPNETPKEPELASESQNRVPVNIETGKQNQIDHRDEDEEDNNDHEETLPKTNGTIYIQGTNISLQTEEDIEKWIEERILFTTR

SEQ ID NO: 21940 - protein, 109 aa, Candida albicans
TPNPLLNHLPDHHAWLTFSVRSLDITKIKMKFEMILWQLNITNKADKSLTMFQSSKNSNSSMLKICNIKQAKCTKAAKNAGVFLNHIPTNGARVKDITHTKKRTAEFSR

SEQ ID NO: 21941 - protein, 73 aa, Candida albicans
IIKGKNEMKKQTNTESTKRSIQFRTGTKLWQPGVGLSSVHAAVPLFNAPRLINKDIKAFTDNIIDKLLIWNPA

SEQ ID NO: 21942 - protein, 76 aa, Candida albicans
KLLLIKWIVDSCVYPFPSLLQNKISIKLVKKKKKKKKKSAARDKKWVVHRITNKSRDTPSNIIENFFFYKIPTNGN

SEQ ID NO: 21943 - protein, 110 aa, Candida albicans
VKDEKDKKKKFLLLFNARKAHLILPCIFVFIGSYSFSSFIITITKLYCQPENYELFNLLVYSIYITSTFFTLPSFLYLSDLFPSPPLNFFFFFTRNFISFPIATLPTLDT

SEQ ID NO: 21944 - protein, 66 aa, Candida albicans
KTLFVFPINKNLSKAYYVSRVGRVAMGNDIKFLVKKKKKFRGGDGKRSDKYKNEGRVKKVEVIYIL

SEQ ID NO: 21945 - protein, 119 aa, Candida albicans
VRGLSSPVVKTNTQTDISVTDTNVISPSLVDLEEQSGLQDYLATPPTTQETDPLLAANNKSSNARPENSNTDNGNENENDEVYKDDDNMSRVLRLARRTSFIWVCCLGVVALIIFQLTF

SEQ ID NO: 21946 - protein, 63 aa, Candida albicans
GGREASDNLPGREEPFLTSDRANPQSVVLNETFYERGNCNSWTPQRQKFPLKRVRDQHSEWSG

SEQ ID NO: 21947 - protein, 66 aa, Candida albicans
  UNSURE (23),(25),(26),(27),(28): Identity of amino acid sequences at the above locations are unknown.
IIQIIQLFLPHHSPLNSFFSFPXSXXXXPTHHTPHTTTTTNYLYWLELKIEKEKREKNEVRKTRRI

SEQ ID NO: 21948 - protein, 453 aa, Candida albicans
IIQGKYQKEPFIDVEKKVASSASASVSVYGSNEPLPDPTPLMITPEEVSNYDDRPWRPFRWPYHQTMAIFKLDINHWLDMDKYYMHYIKEKERIRHKYGKQNFDMLPEGYDGCFELMETVTNHLIARYPLLFTVLKDGNYEKGKTGDGKIIRNEITKEILDMTLPLKESPLVYVSKLAKEDFYVVKKNPTDRLHYLVGAAVPFPGGSFGIDQKIGHHIDTIHADVPYYKEKLKKSMERWFDRMKPNDPVERASWYITWDVKLKVNNIYQRPEFKPNLEAEMKSTDPKEFNVRVERQTLRRLPKSNVIIFTNHPVFYSIEEMKDEPMIPSLLKKILYEGPEDILKYKNFPLIRDHLAEYLDKLVARQYELGIINDETPLKTQPTYPFAYWSKTNFDYVNGWSYPSPPYDKKNMKTDSSKNVKLADNEYAFNLIREFPYPLSQINYKINYSFLSN

SEQ ID NO: 21949 - protein, 68 aa, Candida albicans
KWQTIKDLQKGMAMEGRFLEIDNFLRTVIEQNYRNRTDCERDLKRGRGVGAKGRLKVLLQIVLKSDTL

SEQ ID NO: 21950 - protein, 62 aa, Candida albicans
KIRKFNEYQFLFPLIICSKSVNVNFYPNESFIIFFSIFNFQYQFESHPHIEISIYGKLELID

SEQ ID NO: 21951 - protein, 71 aa, Candida albicans
PGFHWEGKREIQKFLDTKPVRATLGGWVKGFSSQPKKRDETVVNFTIFGGRGKIRQVVKGVQTLIFLLGLQ

SEQ ID NO: 21952 - protein, 160 aa, Candida albicans
QTGDLLRIIKFIVRDSDDSDEATGSIKCMRMAPKSPTRPRPRFRNQKQKQKQDYQPTSAITLESSNESFSSEIIINKSNPIHKNIYCVGLLLNSYLDFNNDQLNLKLKVQETSSEEEEEATEDLIKEFPLSIVSLETTVVKSVLAGEVGEEEEEEQAQMN

SEQ ID NO: 21953 - protein, 65 aa, Candida albicans; identical to SEQ ID NO: 21638

SEQ ID NO: 21954 - protein, 65 aa, Candida albicans
NTNNHKETTLNDLTSQPTLPSPKFYSRNEHQYQVILGLNLLIIKILKCTIIVEYLFSLPQRLCNF

SEQ ID NO: 21955 - protein, 85 aa, Candida albicans
TRSLSVGKRPLQLHLNELSTRGHNGSKITRIDDLLLVSFRKVFITEQGIGGGDRETSQFLGNAESEDLTGNGLLTSTLTVLSSIS

SEQ ID NO: 21956 - protein, 68 aa, Candida albicans
VNYPIFFNFILFFITIFFLNLTKSTFFFKEILLSIIVLYYGDYIFNLVKEGQESLNLRFGFFINRFCF

SEQ ID NO: 21957 - protein, 74 aa, Candida albicans
  UNSURE (32): Identity of amino acid sequences at the above locations are unknown.
ISNWLTNQYTINLILFFLIFNISVVFIFNLLXFFVYFSNKLCFFFLTLLFLINLFNFQKKKRSPRQKNVKFNIC

SEQ ID NO: 21958 - protein, 99 aa, Candida albicans
NISIERRKGKERRKERREEERKKERKEEFFEGGEFIPLKYCFFNCVCFPVAYFQTSSKSNFAFHSGANKLKAKPKYKKQKSKNKKNFFLIESCTCELKK

SEQ ID NO: 21959 - protein, 292 aa, Candida albicans
KPTRSDISNFNATAQNPNRLPVQRVGMARALVGHQRQQQFQSEKSSMYKNGNPSLYSQASAVPQLKNRPSYDQMKSLNKRSSRQSVISKDSSHNDDDMISVLSFDTMNLPMHDESDSQRFNQQMEDFNVDDYQDKYDLTLELQGSPYLKEGLLKLKILNNDSVDEIDGNSNPSASSTPANHGKFLSFFSRPANSSSSTSNMNNHKFTENFVVISKGELSLYSFDPKVIKKFKKRNGHQQQQTEPDDDDIVGDGNWLKNAAKIGTYNLCSTYADLEKTTSQGNLHHGPGRIRT

SEQ ID NO: 21960 - protein, 79 aa, Candida albicans
  UNSURE (4): Identity of amino acid sequences at the above locations are unknown.
AGLXAVVKTGDIKLIRNVNKQNKKKKRRKRKEMVMIIYNRFRILCQSVSFTIHTMNKLKKENFCLLITKNKQKYYYSIG

SEQ ID NO: 21961 - protein, 372 aa, Candida albicans
TSNKIRGAPYYSTIGYVDFNTVRKLTTNSSFLFRRKLTQPPKTSNALSRVFTRNKSSSNISIHPSSSDDDSSPKTLRESTSPSESSKSVSGNKLRIAKKLKFPRNQSSRKPDLFLDTSSTISEDSSSFRKIITGNLLNEINKSRKSSMSSPMSTTFHSLFHRSHHSGSNLQQDNNLAATGTTLLSGKFDDLSKSSKTTLCLSSNSSNSIISNPELAQIYNFTNPNISIEDGETNLDHINSSFLDIHKKMLVPADLFIQNKLNKYHQTEVGLGIYESDLDHDKDSKIYSNLYHYLRSLFTPSFSISDSGQKSKMHPILGASVEEIANFVKESFCLHQHNPKKVLEGKQIQWFPLGFEKGKGLEYRPLSIWLKN

SEQ ID NO: 21962 - protein, 135 aa, Candida albicans
VQSGGTRATAGTVYPILGYGCAGCQRLYHSLVPTYILGTGLLPPLARKSGLAGTRAGAEIKLGPEPEPEPEPEPEPEPEPEPEPEPEPEPEPEPEPEPEPEPEPEPEPEPGPGPGPGSMADVPKLKGNGQSQSRV

SEQ ID NO: 21963 - protein, 71 aa, Candida albicans
  UNSURE (14): Identity of amino acid sequences at the above locations are unknown.
AGFACPWGRLFYIXIIRSAQDSTANSTSGLSQTADQNASFQHIHTHRKKYKQISQIFFRQNKTIQLKTKRK

SEQ ID NO: 21964 - protein, 131 aa, Candida albicans
LSLLFQLILQIYIKPIIIVINQTQKVVYTHLYKPLSTINNYQMTSQAPLQEDTGQDIQSQEPYSSRYNVELVDTFREFKEFIDYRFEGLVKSMNSLEERLHQLDVKLKAFMQKQEEYFEKITVESVSNGKK

SEQ ID NO: 21965 - protein, 80 aa, Candida albicans
NDKVIENTTRKKAMCCPWFPPYSNRDMFTIVACHVVNGVVYYTVRYKNGQYQIFPEYTVLIYAPDEVMRYHFNNGLVDYQ

SEQ ID NO: 21966 - protein, 63 aa, Candida albicans
RITLHMPMWHGRFISRKIVNLKFQNHMRKCNYNLEYGSFRRQYPSRCLRRSNVIFVVLDTSSL

SEQ ID NO: 21967 - protein, 63 aa, Candida albicans
FSFANRLSLLGLDMNYKIHVYLAILYTNKIYLGLRTILSSRFNDQKNQAIHKERNTRNLQIIM

SEQ ID NO: 21968 - protein, 86 aa, Candida albicans
LSRLTSRTYCHYIINRLAQAFTQQQQPQQQQQQQPQYTNTVYVQQQQQQQPQQPQQQPQFTGFGQTQQTGYMFGQYPQQQNGYWRQ

SEQ ID NO: 21969 - protein, 65 aa, Candida albicans
VIHPQMLRSFHYLDLLNGIKSGDIQTRKYYTKKYGFGNFPMAGFIWVGNEKYKVFLNNPIILKFK

SEQ ID NO: 21970 - protein, 61 aa, Candida albicans
KKFFILLRILITHLLIYPFVPEIDSHKFHHTITTVNYSLLLTNQRLTKKKKIYFSILTYLN

SEQ ID NO: 21971 - protein, 71 aa, Candida albicans
  UNSURE (70): Identity of amino acid sequences at the above locations are unknown.
IISNSLFFFLFYFFFFFFLLYRFKLLIQTNMISRNLRTSSTKTFYGSILRSLIRSVSTNNSSTSVIHHGXE

SEQ ID NO: 21972 - protein, 60 aa, Candida albicans
  UNSURE (16),(43): Identity of amino acid sequences at the above locations are unknown.
HPTISFLVKPKTLDSXSKIPYLVSHKIWFALFLESINGQNLTXNRWCRDEHNRIRIILTL

SEQ ID NO: 21973 - protein, 69 aa, Candida albicans
DNKQHSHLVVLRLSLWVVTRPFLLSNTVYNSHQSCLNDEQEKKTKKGSKKKTHTYFPSLPGIDKQFFHL

SEQ ID NO: 21974 - protein, 136 aa, Candida albicans
TNNSFIYNLTNSSKMSIFKPRTIVKQSSTLPTAAVHELTKNQHYCVSKLPALPSVFKSQADSFTNAYSDSESNYSLVINEDSIFVWCYKSTDATPLSIEFPIDKSIFQLPMAILTRPSSGTGQDPGLVILDSVSGL

SEQ ID NO: 21975 - protein, 66 aa, Candida albicans
ECVLDNQMKKIKTMKKQMKKKVLEIVKKLKNPRNNKVYCYMFILKKMCTYNNSKFWLVLSLLQPRT

SEQ ID NO: 21976 - protein, 60 aa, Candida albicans
LFPTRNYTKRGIVLSTQAIKQIEPLKKLRNKTFQGVKEKHAQLSNQLTTIEPWRSLSQVD

SEQ ID NO: 21977 - protein, 417 aa, Candida albicans
PMADPCRLVVKISYNNNNHNSDVSIDEKIAKIILNSKTSIRENGSDIIDNLPNGEYNQEKQQQEDEEFDDDDEEELDEFDTNKSYLKFLNGELQESINSNEDDNINGGGGLGGGRGGDEDYEDDEYILSDGDTFNEELLESNLNASGYEDEYLSDGDLEFDSDRFKEKNIFNDEDINDHVTKGHLHRYPRTRLNKLKFGSLSPSPSLLESDEIDLVNSQLSNPPHNNDMNWKQYIIISLVSFLMTILGYLLITGQISTILPNLLPISGSFDPIKMAKLDGKLHRLDQELKNSHQKQQETLFQLQSQIDQLNNKIISIIDNQQQQQQQQSSRNNEDKSTTTTNKKHEDIITLENNQIQISPEFHQFLYKFIDKYQNSYLDEKLQQLEKFNDLQQLQNYVEKLISMSMESIKQYILIYI

SEQ ID NO: 21978 - protein, 75 aa, Candida albicans
NIADLVLQQGITSKKKQKFVNPKKTKNYQFNSFYINSFETIASQQFTNNFILTILFLFCITSFSTRKCILSISWK

SEQ ID NO: 21979 - protein, 81 aa, Candida albicans
KGRDVKNKQSSFKNMTELMCVYVWVTKMVTIVVSQLSFIHASLGNDDNCKNVAPKKKKKEETILEKHVDGHSHSETKRMTQ

SEQ ID NO: 21980 - protein, 66 aa, Candida albicans
TKIGLHVLVILAPASFFCNKIILQWLLIMFQTRLKQLLEFFKKKTATNGLRFKNFQNPLIFPYQEL

SEQ ID NO: 21981 - protein, 365 aa, Candida albicans
PLFSYNKMQNQPPNQLVYLQDGLLGAENSGHSQKKILPNTSSKNEQCAIGPPATTQGFIQNTTQLPLVLQYPTILKHQFGISSSNLPQVQQRHIINSLPVYSPNFNFFYSKQAPPPPPPPPPTLGYVVLPNTIAERQTIATFQKDRNNPKPNKTEYSETFIPVQPKGNPKPKIHRMKEKYTIEKSLESYSFGEIRNLFKSKTGLSDMHFATNRIEDVRENQLINYFSYSIGKALDVFASHEIYSQIFIELALLDDTNVILNGIFCLAEYELSKEDFTKCMHYYETTIAIIHSQIQDKSENRPLKYRCLMAMMLLCIFENKFPQIELSHLQHYKNMTVELFKNQPIDEIRLDPFSPAVEGHCRSGG

SEQ ID NO: 21982 - protein, 194 aa, Candida albicans
TTQILLVMEKSLQETLIPKLTFKNDEDVENENRTDSSSFDDDMETISQDNEDGEQDRRNRQETATEENAQESEAPQFETTIIESGETEERDGDDTDSGELYSEQQQNKEKEETVPGTSTPKIPQRPPKKLSLSRATTNDSLTSLNSTSKPPKPVISKRPTTEESLSNIEPTIPSRPAINQIPSVGDIPTRATSC

SEQ ID NO: 21983 - protein, 91 aa, Candida albicans
MPGIKKNRKTYNQSSFRRVLRSKLNSNEGSNTVGIKSDNCDILIYLIYMNYVNELINEGAKSQNGGAGEEGEVTEERLNNANDKLIKKYRG

SEQ ID NO: 21984 - protein, 205 aa, Candida albicans
IYPCTTSTESTPATESTPAYESTPATESTPATESTPATESTPATESTPATESTPATESTPATESTPATESTPATESTPATESTPATESTPCTTSTETTPATESTPATESTPATESTPATESTPATESTPATESTPATESTPATESTPCTTSTETTPATESTASTETASSTPVESTVIVPSTTVITVSSCYEDKFFTHSGWKDPRS

SEQ ID NO: 21985 - protein, 477 aa, Candida albicans
RNTRPSITFACFFYTLTTERHSQRYRLLTKRFFRYRKRECEKKMKVSQILPLAGAISVASGFWIPDFLNKQNSNSYPGQYKGKGGYQDDCGDDYKKGYKSKTYSKVKPITSTDCTTPIQPTGTTTGYTKDVVESTSYTTDTAYTTTVITVTKCDGGSCSHTAVTTGVTIITVTTNDVITEYTTYCPLTSTPATESTPATESTPAIESTPCTTSTETTPATESTPATESTPATESTPCTTSTESTPATESTPATESTPATESTPATESTPATESTPATESTPATKSTPAYESTPATESTPATESTHVLQVLKVLLLLSLLLPTSLLLLLSPLQLPSPPQLLNLLQLLNLLLLLSLLLLLSLLLLLSLLLLPSLLQLLNLLQLPSPHQLLNLPHVLQVLKPLQLLKVLQLLSPLQLLSLLLLLNLHQLPSPLQLLNLLQLPSLHQLLNLPHVLQVLKPLQLLKVLHPLRQLQVHQLSLQ

SEQ ID NO: 21986 - protein, 75 aa, Candida albicans
AVNSENHSSKFYLIRKVFSSFIQNFSPNQLNQFWGFSKQCNIKRLCSFRNNDPILWKQNQAIPPYIYESNSELFF

SEQ ID NO: 21987 - protein, 62 aa, Candida albicans
KAILCNRDGDKDTSESETVHRYRHLITHSLHCQSTDKATCSNNFYADGEQIPAIDAPPDCSY

SEQ ID NO: 21988 - protein, 78 aa, Candida albicans
GLQDTTHIILSNYKHSKKFLLLCFSYILRYNLSSPPPPPPPLWLLFHCYFYIYIYMQVMKIYTKKKSRKLISSSNNNN

SEQ ID NO: 21989 - protein, 109 aa, Candida albicans
CNSIFWIPQCSFIRWINLISDDFRQLLYDQDEFALRLLFVFSSLCLYAGFSLNDEFNIWKDFIDWYKHDQEGKYNGQFKYLMDGKLYQLIIVEKKRCNKFKEFPELDVN

SEQ ID NO: 21990 - protein, 91 aa, Candida albicans
VVSILVNMSQTLKKRCGNSSGRKSPTTSNIEFDDKKTEFDLNAIVPPKEPEYKYLAALTLVTLLPIYPRFTKLGTPNKVVFDEIHFGMSAS

SEQ ID NO: 21991 - protein, 106 aa, Candida albicans
KLLAISYRCYYRISFLKSVTCLLELTQLNREGIGQLKKTKNEKQIKKERSNKNGGDLYYIIWRESFSEKKISVCVLSDNAKTQHVNQNRQKKNYSIIIPTKSCVSA

SEQ ID NO: 21992 - protein, 63 aa, Candida albicans
IDDGMARNSLSRAYCVHQEISQSLLVLIKNDQGREDNSNQVSPFTYKTVKLTTCHLSWECKFR

SEQ ID NO: 21993 - protein, 77 aa, Candida albicans
QYVGSLLPEEDEEDPLAPLAPVAVAVLAPVDPLFFVVVVELVVVVVAEEEVVDDDDTVAVVELPPTRFPVVVVFSLP

SEQ ID NO: 21994 - protein, 217 aa, Candida albicans
KSNISNRMNFNKMYFNNIDFNKFYEYLNDNYNARLFYGDLTVLKDKLNANNGQLTEEEKELLKKGILYSVDTAKWVLDNMDEFQEYCSASLLIHNELNIELLKEYEPETLWYPKIPTENTLREALEIRNNETFIYKVAKACIIGRYLYCFNSLNVCCDKSLLNMCRERSTRVFLDVYMDKFYDSKYMGDVLRIGHIDAPDNESEFLKVYENEMENYN

SEQ ID NO: 21995 - protein, 378 aa, Candida albicans
LISPAKIGRANNHGMTKFLLMPLFDSLTNMGKLNEFVIAFWYAMIKWGGLRINLSIFNNNNNNNNNNNNNTTTTTRNVLNGVIKDSETLSVSNMAAGNKLDRSVIDEVILGIFINKITEYGREKGLTKTHLIMELFQTLISKDLNPPPPSLVGKDKDKDRIQIQFKYLMRIWWAIHDDLEYYHAYNQNNNNNNNSNNNNNKVDDKDLRFIQLEQFLKNLIIFNDINYQWSRNLLMKKLIPDEFIDQINRILIRLNHLNWFNIGNENENENKKIYLYKLMLKSSIKLLIPQRFITAKKNGNGNTNTNTNTNTLVVVSTYPKLMEQEIFRYIFVKLSKTDNLTDNNIKLLMALKKYRKAKPYNDEEAVLAPTGLDGSEQA

SEQ ID NO: 21996 - protein, 78 aa, Candida albicans
  UNSURE (20),(24),(38),(39): Identity of amino acid sequences at the above locations are unknown.
TCIGKSILQIQIERMGNRVXFENXHLTMERGRTLRKRXXLGRSLFLNVNGIEPLTNLLYAHLLQCLNEFLLFPYHKKN

SEQ ID NO: 21997 - protein, 63 aa, Candida albicans
FSNNLKLKLSSNNAKGKKFQKKKGQQKNSSLFITNKYLSIFFFLRLYVKGKIKNTKFQRIQNF

SEQ ID NO: 21998 - protein, 60 aa, Candida albicans
VICDNCMAGGLTVNMNATIKKIGSSNIDALMYLTHKAIIGNNTALGKIIRDNNDPNSILL

SEQ ID NO: 21999 - protein, 101 aa, Candida albicans
WQSCSYISSKTFYSCSTYLTCINQRYPVDYNQCYYGGSLQYIQMALFINSSAKHIAPFATKSVVKLVTKAINNGYYKHEWFLNMKYLEDRLEQNGTGFFRW

SEQ ID NO: 22000 - protein, 85 aa, Candida albicans
  UNSURE (71): Identity of amino acid sequences at the above locations are unknown.
NPGKKKRKKMNPATIITNFNNSQLQTPPTSPVSFDKYYAYYNIQLEQSKLMPQPSKIKNGDPFTWSDIQFXVFTQTGWADSVPGG

SEQ ID NO: 22001 - protein, 74 aa, Candida albicans
  UNSURE (2),(14),(38): Identity of amino acid sequences at the above locations are unknown.
SXIILGGGEGGAMXVVSILLRKKGGCCLLGGLFVSLFXVFKLNYRITKRKIQPSKKKTMAHTVKAYCNHYYYYY

SEQ ID NO: 22002 - protein, 251 aa, Candida albicans
TLFSLSLSLMSVPILTIPESSFDPASYNNLNTANITKSQSQILLYIIKLTRRSSIGLILFYILGLFIIKPLMELNVTRRKDYLDYIRGKLRDFYLKSITKVQYIPIVAIKNKQTGKLYSDAIIQTDNNNNNKLSTNSTGGDDSDDRLGQNQLYKKLTKLSLLLTEGIRNYSTIELSNYKSINYSIKDLQNKSDLVYFNQNDLFVMDNGGSGGGGVSSIMTTSGNTMKKKDLAVEIKNEIRSIKGLYMSGQV

SEQ ID NO: 22003 - protein, 74 aa, Candida albicans
PEDCTGAVNGALSCKFNGGSTNVVVVMEEFVEGLRIGVGPLLAACPPLVGKERACASTGVNKFDTLGTEINCGC

SEQ ID NO: 22004 - protein, 62 aa, Candida albicans
LLPTQSVLNTRMWPMRLGVNWITYIDVVDIFKIVVLLCTKRFEALQAFGDNEDMSVKYSVLN

SEQ ID NO: 22005 - protein, 75 aa, Candida albicans
EDQKRNDGLLNDVNVEKKMKDKNSYRKLESHSCKHGSKGKTKTKIRGWREFVRDKEIINTLNHTHTHIPTHPHTN

SEQ ID NO: 22006 - protein, 103 aa, Candida albicans
  UNSURE (5): Identity of amino acid sequences at the above locations are unknown.
CQFSXWAGRKLHFLDSDVRQQLVYDSLAIRLSCRNDFHVGPSRPPPKISTRGGKKKKCVRVLENTAWHRTGHARFIFQCVGCWKGWREQQQLNSYSYSYRKTN

SEQ ID NO: 22007 - protein, 86 aa, Candida albicans
YVLLLMYVEVSVRMIKKGKKNFRFLVHGQIFGLNILMCLLTHMLLILLYIYLNIYNVMFVNIYIYIIEFPQYIYNLILSLIFLQFL

SEQ ID NO: 22008 - protein, 60 aa, Candida albicans
HCTTHIISSEHRKSDKKKIIHLTIFTVKLVCIQYSKLVESPINYDDKPGNNSGGYIYWCQ

SEQ ID NO: 22009 - protein, 87 aa, Candida albicans
LLYYSYYYNHNRNWLDTKIFGDDVNSYVIIYMIFLEGTAPTIEKEEKKSNDKFVFGLILTCRAERGKFPSTLNQHQAKKKLRLAPPS

SEQ ID NO: 22010 - protein, 76 aa, Candida albicans
RLFTLLNQSPRVGLWSVLFFDSIILKFHPLTINKNSRFIVFDNNIMIVIIYETAPYQNQKEKERGPRNCALIVKKF

SEQ ID NO: 22011 - protein, 116 aa, Candida albicans
LFQKHNNMKSIAIITILQVLFTQIKAIAIDERGVGIANDDDQQPKGAPIGATSQFDPYSNISPLSVNNTTTATTLSTTKMSMASSNTITGATGSTNIQWKLLLGCFLFAIVSLLAM

SEQ ID NO: 22012 - protein, 238 aa, Candida albicans
IHIHMFNTTDSSRNYLVIENPSANYISDKEEERYSNDNDIVHNSSNYYIPSLDDISSISTSASSHGTTFFSNNQLNSNRYGTPRSLSKLRSIESEIDNLPLVFKTNIWSNDYLVTHNKTANMFANFTLETGNVACSLNTANCDKSQLQYNDASYAVTTPQVSPIGNNPIAAAGNSSCTFDSTTPGINANAACFQALLIHHLPSCLNFRRYTGAIFTVPKTSKFFVIKSYNILDVNASF

SEQ ID NO: 22013 - protein, 61 aa, Candida albicans
NFCQIMTSENIWQMSKSISIIQKAHSLSIRRVANKSNGYMPVYWGMTTTTTTTSKYVRTDC

SEQ ID NO: 22014 - protein, 77 aa, Candida albicans
HFFLSTCSNKLKGERERNLGPPLNFDQQKKKLKHKFHKCHFRSLSFHFKAIKLILRLKVFNTYCNFALREKIIAIFQ

SEQ ID NO: 22015 - protein, 66 aa, Candida albicans
FTNYHIGIQRIYHSFKTKLVELVILRWGMFVLVSFVCKKTKKQKYKKKKFSYKNTKQTQKITKNRF

SEQ ID NO: 22016 - protein, 90 aa, Candida albicans
YVQYTALFFVFFLAAMPLRMSITGAQPQFQLIFSWNDHVVGGDPTKNNICHPSYACPCSKLIFYNVFSLFYLLFLNSYSDPLLSGHLRSE

SEQ ID NO: 22017 - protein, 104 aa, Candida albicans
EYARYRPAPRWTTNEKSRSFIGGLSIVIHANNGTTLNCANITLLDEGHGNANTTMSNSSSSSSQSAVNTSSSMASTAPQGNGAERAVVNGLLAAGVVGVIAALI

SEQ ID NO: 22018 - protein, 61 aa, Candida albicans
QMTKFRTQRQCQLIDAYTRYNKNLVYLGNIMIFENRIPHVCFSHAFSCLYRIMKVLIVRCR

SEQ ID NO: 22019 - protein, 62 aa, Candida albicans
ISYLICTYMSLWIHLLNLLIVFSSSNLSSSNVLLFGSIMLTAKADEETSIGCAILIIYLYIK

SEQ ID NO: 22020 - protein, 68 aa, Candida albicans
  UNSURE (56),(61),(63): Identity of amino acid sequences at the above locations are unknown.
PILMSTYSIPYYNQMNGNYNNGMPQQTTAANQQAFPQQQQPTTTGNASQQQQQAAXTAAAXAXMCPTA

SEQ ID NO: 22021 - protein, 61 aa, Candida albicans
  UNSURE (8),(9),(10): Identity of amino acid sequences at the above locations are unknown.
FARRVEDXXXGRCSKNFNCILCVCRPCFSSSDWLIYDLALQKRITGGSVKNLGLTFVIKKS

SEQ ID NO: 22022 - protein, 91 aa, Candida albicans
GNVITHTINKKEPRMIHLHVLIQMHKIKIIDQHEAHHYGLASIKSHTRLALVFCDWFYYTHRKIQQHRNKYNNNTCGDNVKCAQFKFSTDR

SEQ ID NO: 22023 - protein, 61 aa, Candida albicans
TFIQVFFLSASFTPLLLGRQKKKMSQFSQHSKNTVDLFFSYTTSITNSIFLSASRYESQIK

SEQ ID NO: 22024 - protein, 67 aa, Candida albicans
FKSSVQNGGKFLWTLTSSSLLLGVPLALAILSETQLQEMERGMSLEKSAQDVLAPGSEAAFGNENKK

SEQ ID NO: 22025 - protein, 92 aa, Candida albicans
SLYNNNIRLSKNNQHKRKIMSTPVKNDSITATSSTSSSTPSQPPMQNNSPYPMQPIPQPPSSQQQQQQHLQQPIPPIPVQIMPQPVQPQLQQ

SEQ ID NO: 22026 - protein, 83 aa, Candida albicans
  UNSURE (23),(58): Identity of amino acid sequences at the above locations are unknown.
NFSTLGTQLGNNGPVSNYSRVFXLQILQHAPEYNNIILSHNHLTFYLLAQQVGDILPXTPPQSILYTCSHYTAYTSPLCNIPV

SEQ ID NO: 22027 - protein, 78 aa, Candida albicans
TDYYHYHYYINYWRIPIFFYIIFNFQRIKLLIVTAKLQQHQQIQTTKKKEIIHYISRPPESSSTIIIIINHYIITTFG

SEQ ID NO: 22028 - protein, 104 aa, Candida albicans
KLYKKKLEFSNSLYNNDNDNNQFINENNIKKNTTQMKVDNIKYVVSSSNDFIGKIVNDTKFGIFRKTSLKIFHYHQQTITPRRKKRKERKLKLFFWLHRTIIIK

SEQ ID NO: 22029 - protein, 71 aa, Candida albicans
NRVNSYSLRFDLFNIVFFSSLLLVTKLCIKSPVNSSYNSQQQQQQQQTSKQAGNTHYSYLTPFTGFFPFPP

SEQ ID NO: 22030 - protein, 110 aa, Candida albicans
  UNSURE (107): Identity of amino acid sequences at the above locations are unknown.
RDRESNFLRFKDYKGKFSYFLHTTFSPLVLFKHFPLFPRLQPFFFFYLFIYSFIFSLFRLLIIVVVFFLFVKRLSDYFQQQHFLNYIQFRREVYTKNSKPTLSSLSXFLV

SEQ ID NO: 22031 - protein, 202 aa, Candida albicans
  UNSURE (28): Identity of amino acid sequences at the above locations are unknown.
LIIMIRTRGTNSPSNIKEKFPALVKPTXKNFVNHNSQPIRYTIILKPQPKKKAILMNISQTSNSDYTPNYINNINNRTWSSSSSSPSMPILGNGSSSGAGGGGGGGFNSSGSSSFASSRDSSSTALDDKKFPTLQKKKQIKKVIIPRVNEVKVADPNSWGKKQSQPSITPNINNDLDGIEIIDKRKQKMKRKQEKLLFSNAI

SEQ ID NO: 22032 - protein, 70 aa, Candida albicans
VYLFSFPYQHLKKLLICKTRQQLKYNSFKKHISWFCSVKYKKIPSKAAATSYSKNNNNNNNNTIFIQLVP

SEQ ID NO: 22033 - protein, 123 aa, Candida albicans
LFKSSFTYYLTCRVPIHNLELLALSMSFPPLENPNLEGYEIARQLWIEYYNQREGTFVARKKCNGCYNENKFVVWAVAVAAQAIVDGARIYPELKPLVGPAIQIFQKYKKYHIKGYPAAEKSW

SEQ ID NO: 22034 - protein, 72 aa, Candida albicans
LISVGNILIFQQKISFQHKLQYDQGKNLAFDFFFIITNNLQTFFFLLSSTSTSSFNLYSIPFVEKQKENKKS

SEQ ID NO: 22035 - protein, 96 aa, Candida albicans
SNGVCGEALVSFDSHFMVVAAPLKTQPRDPAAEFELRLDDELLAEVDADSGSLKLFIAKMLMGYSLTNPEELTVLPQVSVNLESNTLSFGSYEKIF

SEQ ID NO: 22036 - protein, 421 aa, Candida albicans
KQLSATYLHISCLLLYLIKTAFIRAHFFFTAKKNQNQNQNQTLNNMEQFYISSYIKFIWVIISHNSTSTSTSTQQSFKSFQQFNTKYGEFLQKLILDSQLSATNLMISLYYLYKHYHTNNVLLHDYCFDVLDEEDEEEEDNELFNSMLIYNVIISLVLSNKSFDDQSFTLKTWLIIIDSTLNTTTITNNKPLINIDLKLLNYLENYFLSSLNFKLSFLDIAINPKFWKILSNSKIFSINQTILNKFKQLVMITNPTNITTTTNTTTNQVTNVINNINLVFSPLPSTPISSSMTMLATTYNGINNNYKVVANSNNTTITPFTNYSLTPAVVHVRDHIQGYSHSHTHSHARSISSNNNNNNNFSSPLNNISTFSSPLNHPSTPSTPYYDDNYHVCLKRRRIMGAGSSGQVPTHYYLTPHPKTQ

SEQ ID NO: 22037 - protein, 217 aa, Candida albicans
VIVKLINIELTPEINPVYAGGSWHVEGGINEDIIATVLYYYDVENITESKLSFRTGFDDPNYEQGDDFYTETIFGIKDEEVMVREIGGIEAKEDRVVVFPNMFQHHVDPFELKDKTKPGHRKILCFFIVDPYNHNVVSTDNVPPQQKEWWDDSSLDYLFPGNLKQQMLDLKGGGTAWPMTFEQAKEARDDLIDERIAQSEGDDYEGAFSRYFALQET

SEQ ID NO: 22038 - protein, 88 aa, Candida albicans
QTPRTIPKLMSEELDRILSIEESAINRNKEIDRILQCSPYDYYSILEINPLLSTTTAQELLTTIKKLYRKKSLLIHPDKSHHAGEDPR

SEQ ID NO: 22039 - protein, 88 aa, Candida albicans
QLLYIDLFKLITIESKAHDGYQRSINKQLNRQTSSISRHVNSMSTTFNSHTKTGFFVVASPIIRLPQSPSVRIINICLGFKTVLVWSL

SEQ ID NO: 22040 - protein, 76 aa, Candida albicans
  UNSURE (43),(58): Identity of amino acid sequences at the above locations are unknown.
RNGDNVDPAAQSNQEVRWEKTDYNSLNRRSSFPKTIFSLSSLXILVGCFPIHNLHTTXHYTRVFKFFNLSPFLIFF

SEQ ID NO: 22041 - protein, 99 aa, Candida albicans
  UNSURE (87): Identity of amino acid sequences at the above locations are unknown.
YQSIYYYTYIHTFIMARKQVKSKVAEKVEKKQNITTPSEKSVEDIEHDLQLPPSSDEEEDIDQDELSEENSMVMKTMMKSNPEDPFXGFSDQEPEEIPP

SEQ ID NO: 22042 - protein, 288 aa, Candida albicans
RKMAILVSGTKPLQSLYKAFNPLFFYANLLIFLLVVIYSFNCLEREKKYPRSLIKMGSDVYKLDKLADYLIPDTSIIAINSHLIKHIYRKEIKNLKQLKLITYTLPVLSRYKQTAFNNQSLFSDEMKSCYEIMELCAVQIVTQIGAIINHTWKYGENASHVAEQFVFLFDSIFRGDLPLVSKLTNQQIRYFLLESFNDLYLHRQIQLIVYSIFLGLDKIELRNSIIEMLELKYGYEIPGHLFVVAVSSLGLQLYRNELERNHEHKIQKLNKVFRWKKIAKAQSKETRR

SEQ ID NO: 22043 - protein, 61 aa, Candida albicans
LVVPIFTGPSIKGFFFSLELCSLSYYLLFFFICILIDTDTNDNNDNTRQSTGSNSLHTGFR

SEQ ID NO: 22044 - protein, 67 aa, Candida albicans
DQFLPQLLWFTIILQVYFGRLVIFAQTFQQILNKKISTHTFILSLIEKRVLENRTNFNFSKADPYQV

SEQ ID NO: 22045 - protein, 77 aa, Candida albicans
LDWLRLSTAYGLWGGIDSPFFFFLPQLEMEFSGYLFGLVISYSRSITGLLYLLITLPTAINLTLIQIPKEKSQLLTR

SEQ ID NO: 22046 - protein, 70 aa, Candida albicans
RGQLVNLLPNDCRMFKTNSLSNDTFYWQLVTTYINTYRLNLAQIFILHFNQRNNLLNNASPYIVYHLVSS

SEQ ID NO: 22047 - protein, 111 aa, Candida albicans
LITVMSFYNTNTNYSPSFNQLSPPLPPPPQQQQQQFSGHLSSPMKRNNTFKSKLKSLKNELHEAMTLTTITTTTKPPLLPWSRPPTRSNSTSSYRSPFSSIKLSNGIFPTG

SEQ ID NO: 22048 - protein, 61 aa, Candida albicans
RSGIRSFSLVVKLITFRREFRKHNLSWILNVIHYIQVSKIDSLEFHGLTGLLIRIDVKCKN

SEQ ID NO: 22049 - protein, 83 aa, Candida albicans
VNDILEILLSHTRSTYLSKKSSTIIATYITTPFPVILRLTTESTKVYFRYEDYGYIRFYCMFDQCFSFGFPRMDNKCSFIFYQ

SEQ ID NO: 22050 - protein, 66 aa, Candida albicans
EKKTSRKIFDEFLNEIQKKILICTRPSFLEYIDISIVNVRLMIGLFRKYILFFEKPASKIKVNSLY

SEQ ID NO: 22051 - protein, 207 aa, Candida albicans
QLTLPHLFQSYLDLLQNQQKYTSDMRITVILGFTVCLTNAFPLDFPEWTTNAVSFFTNDGYRNSDRLIKLGPENYRIVSENEKLKLKRNKINFIDATNQIPIESAIEQGLTLKPAPPSLWRKFQLMRSKQITTLKKKIPVYNYPKHPQYEKKVLSIFQSINVEFMQEKLSKFTSFYTRYYKSDYGAESAEWVIHQISYTLAPLKILY

SEQ ID NO: 22052 - protein, 73 aa, Candida albicans
SKGNGIKQEDKKVGTEKKRGTENLGNLIEFIYNNDNDNCSINNNYNNDNPLTSKNNLCLFVSSTCMNVVFVSL

SEQ ID NO: 22053 - protein, 111 aa, Candida albicans
LIFAVYSQITYTHKLTNISMTQLPSVSELINRTGSIGSSSNITRVPPMTTTSATNTTTAATATTVTSTTPRSENSYSPNSPYSLPTRPSNTSLTNYSAGSGITVASSPLSS

SEQ ID NO: 22054 - protein, 211 aa, Candida albicans
LLDLTTITRIIPMETSNTSIELFSETAKLPSEVIAIIVGYLPKCILPNLLYFPPIREIVASTILSDVHIGTYIFRHEGSDEPDVGYSKCYCDRFDIKFSNLKKGIEQWNIYPKAIHMEIEVHFKNVLDTFPRLLKEALSINGSLSSRKGSEAETVLNLILNSNIRFDSLELSNFRGPIVPPVATNIKLSSTILNSYNISGMKKLDIKMDFK

SEQ ID NO: 22055 - protein, 68 aa, Candida albicans
NNFQRRKRRKGKKQKKFSKKKCGSDGKVYIVIDSRVSLYNYFTIEVKKLLCLGGNSNKNRHLKSYNFN

SEQ ID NO: 22056 - protein, 139 aa, Candida albicans
NTILDIVLFKLVTSIMEVKDIFVQIGTIIVFLLEFFFRNSITLIVHAHKNYPDITNVIFFILGVYIIYKILVRTLRSWFNFMIFTIKLIFVLFFVFLVFVIYLRGWETFIYQDVPFLKKSFGHLKAFNDSTTKEWGVWL

SEQ ID NO: 22057 - protein, 83 aa, Candida albicans
SCLSMTQYLSKDSLFLKLPTDLSKDEISVLDLYHDITSLTTTPTPKVTFDSIIDETYYLLKSTDDISKCDLHLGTAITAYSGE

SEQ ID NO: 22058 - protein, 166 aa, Candida albicans
  UNSURE (113),(122),(150),(163): Identity of amino acid sequences at the above locations are unknown.
QELRAYHQVKYSKLAEMIRRNILVIQGRSFCQSSYLAESLKPKPDIENKVTTNGDSNDITKIALNTNKPGDDGSLKRDDRVKNLINRLTATGRHEAKRNPTTTNASECYKLCXNPDKLKALXRMFAQPKVSKRAVKKHVKEKFQKKHTEXKYQNITETFSKDXSTE

SEQ ID NO: 22059 - protein, 69 aa, Candida albicans
  UNSURE (69): Identity of amino acid sequences at the above locations are unknown.
FLIQNTFVVWTLDVHVHVNFVNKQHAMKVYFYSIATSIQFTSKNGLGRKYCYTEILSSSHTPLEGSTLX

SEQ ID NO: 22060 - protein, 64 aa, Candida albicans
CSLMSFAFTVLGNIKDFGFLVKNSWQRIKWVGLSKFFTVFRKKLLLSWLPWKIDNSIHIKHYFL

SEQ ID NO: 22061 - protein, 65 aa, Candida albicans
HLSPILVENVVSLPLIKLQIKLSLLCRDKIFMHAIRPKKNKTYSLWVRSYVTNIRDLLNQTNKPL

SEQ ID NO: 22062 - protein, 88 aa, Candida albicans
  UNSURE (79): Identity of amino acid sequences at the above locations are unknown.
MGQTLPEKKKKKKERKGKKFLGLKNFSLYEREMPSTEVRFILKCDTEKVKKRNCIIYSRFCVDYVQDIRHIYTHRDLTXKCKSMLISP

SEQ ID NO: 22063 - protein, 63 aa, Candida albicans
ISFFPFSPLSGTFLLYPFTTPLITVSIFLAPFHFLVRYFFITPIFLFQFLIRLLPYILHFLFF

SEQ ID NO: 22064 - protein, 133 aa, Candida albicans
AGIKKKSSLRDKSSKRSQSDRVSQFKQELANDNNKNVTPNSEITFSSSSSSSSYHENPFLRLAKSTKKEKQQVKSDKFVNRLIGDSTKISKSSLRRRKRKAREQLKPKLDDLLSNLPLTNNEQASSLRGAAPR

SEQ ID NO: 22065 - protein, 124 aa, Candida albicans
RSCIFRHNSHILKIMHTSLKCVNIPNIINYMCSELVAKLSTQFTLYKPYKFSTFLYFFILAFLLESINTFLSFRYIFHLLIDYLSIYQNTTQSRAKKDIRRNFILIAPQATNNKPRKVYTPDLL

SEQ ID NO: 22066 - protein, 278 aa, Candida albicans
KFQHQNFSICFPFLLLLLLIIILLIQIFNLFTFYFKKFFYPMKATTFTLLLSIATAINAAAFEDSRLKALFARDAEISFGATLSAEISHGFGHHHGHTADLSSEIGGGSSSSSVSESTVEELSTTTTTESVSASVSASVSASVSASVSVSSSAEETSTEATESAETTDSFETTDSAETTDIVETTDSVDTNTTDISTTDETTEETTDATDSVETTFESVSNTEDLSSSSSSIITDSSESTIEETPLITDTSVPSSLSEEFLLLVVVLKGFIYYCCHFP

SEQ ID NO: 22067 - protein, 91 aa, Candida albicans
EEEEEEMENKWKSFDVEIFRNKLVGIYKSQQLRVLIKLSLAIIFCLFTFTPRSSRSKRNRTSFFLSLLSIYCFCIHIYFSTTIFFFFFSTQ

SEQ ID NO: 22068 - protein, 64 aa, Candida albicans
EQIDHIVNPQISTGIVWKNTEVIVYSINHMINMKTAMTSIIVRNYSIPGPFSHPLTGDAIWVQQ

SEQ ID NO: 22069 - protein, 205 aa, Candida albicans
KRYGFIAKLRLWVKEEDLYYFIKHRDQWTKYHSFNTKLSQDPSNTLLQDYSYLMSEQEYENLQYSTDLEHDNPFKKTKKPLELKNSELEKLKHMNESELLQFLNNDDILIQFFNAKEFTSFHELEIMQLTFGKSTAKLMSLAIDFPPIKYEPYLYKLNHDLDTFENKVDRYLALQDAYQQEHNNSPSGGSDNGFMEIEEDLDFAF

SEQ ID NO: 22070 - protein, 71 aa, Candida albicans
ILFDPKNINKEGVTIESNKLYTQLTKILIQTTINYYSFVLYCSVGVVVYSCMCGMKNLQQKKTNIKQQELK

SEQ ID NO: 22071 - protein, 61 aa, Candida albicans
MHVLYRPLFLLYQKQKKEFLGIINKSSHIIIIHIHIFKLYEEYCHNIFGSSNFKAVEFLRL

SEQ ID NO: 22072 - protein, 286 aa, Candida albicans
YKQVIKMSRHSSRKCSLAIESPIDDSCNNPLNAFLIYSGKTDTHSNNNNGADDEMATTDESMSPLASSTFLSPMTPPGSRNTTQLSNQQLTKLLRCHRRPSMIKCTSLPELTAMSTHTVTTSPPLSSLITNSTTHAILGNRRISICDLDNFTGEIDYVKQQQHEQHQQQLQSPDIANFMYCNLSTSDIDKTPRKFSFHHRPKTAPGMMIGGSDETPQNHDHEDNEHEYGPKQQEQESMEIDKEKEEVATQNTQLPHHYIENLASFQFRNHKRRNSTALKFEEPKIL

SEQ ID NO: 22073 - protein, 67 aa, Candida albicans
RKEKQKQAKQVREKRKKEKKDKETSQGDKEVDEAKEEEKDQRKKEDQPRKDQEEHERRSKQKYKRLE

SEQ ID NO: 22074 - protein, 64 aa, Candida albicans
TVLRSFCSVFVKKERTKKKKSLQIFKRTNYLIQLQYKIPPTKENNLPRNKKYKKKIKKKKNKTN

SEQ ID NO: 22075 - protein, 92 aa, Candida albicans
PTNFIITTRFQLSTHIHLNFFFFWFLVFVLSFIYKSFFCESEKFIKYFQNSFTLQANHTINLLIDYIPSFTTGLSIFNPLSCSVGIFLVRWQ

SEQ ID NO: 22076 - protein, 62 aa, Candida albicans
LPPGWLVIPLKKPEQENSDIDYKVNISSYHQADLKINNKKPSTRDIITYAIPKEESIGEYEM

SEQ ID NO: 22077 - protein, 117 aa, Candida albicans
FPCCQFIICTMLVIGIIHRWGSINTLNGQVVNVSKTVEEERQLGSKHYCFLILVREEVEKKKICQNLARTKTQFYNTIIIEEKIYKSNYNIHIKTQTTKSSSLFYLVRLNLPNLITF

SEQ ID NO: 22078 - protein, 130 aa, Candida albicans
HSNYDSKDPTNGSDGEISSINGEFIGVNTSFELFGDDDDDYNDYRNRFNNSSRLHKQQGVLPGQFFNVFEASKENDEDTLQGKSVNGINFDDELSTSDDTSGSGGNNNKGDFFAAFFQERPKRQQVEYFL

SEQ ID NO: 22079 - protein, 106 aa, Candida albicans
HLFFIMSITKTASKTVYPTKLIKWALLAKLFSSSFKRVKHKGKSTHKKTIKSSSSSSSSKSSSSSKKHRLLKPHMINKTITSIIFALILLLYMVFVSLEFTSIIKI

SEQ ID NO: 22080 - protein, 145 aa, Candida albicans
SPMRGPSATVVKMIMESHDSTENHINQTNFNNGEQQPIQYVNNSPPPSPPLPPPLMTRNWNPHLLQSTCFGKNLYELTKEQKVGECLHLLNTTFNWFDMIVKSSPEKIDESIGYIKGLERYMLSLATGVQYPWHVDEYGRPMYQL

SEQ ID NO: 22081 - protein, 90 aa, Candida albicans
  UNSURE (23): Identity of amino acid sequences at the above locations are unknown.
ENGRQRIKIWKESKGPRTIDMKXVEKKVELEYDSEVVANAESLEHRQKVESSETMNTLEVETREESKKDTKEKSDDETKEVTDGLKEVEL

SEQ ID NO: 22082 - protein, 76 aa, Candida albicans
CRFTLGAGPFSFEVKNTGAHQSQLNFIPTTPTPTQPHNYPHNNASNNIVAVSNDNGNSRNDQLVGSVPANWTWSSF

SEQ ID NO: 22083 - protein, 220 aa, Candida albicans
LEAMNGIKNLQNNYPIQDQINDTSKLTKQSISIINTIFKNDDDRKFSSKLLHDILILNLPSSLNIKVIKHYYKSNPTDVISKEVALIPLRNAIFNAEFMKAIKLTDLTVGHENYINHMNQILKSGVIKLISTAIIVTLFTKLGVSSLIDAGVISQSWQSIGAINSIILTYLINSSFFISIVKLGRTLINAGGDYLTWQKGTFYTHWFKHADEMLFNFENY

SEQ ID NO: 22084 - protein, 78 aa, Candida albicans
  UNSURE (4): Identity of amino acid sequences at the above locations are unknown.
RLLXLDRLCIWASLVFAESHGLQITTSITVYLHIFYKPYDKYKFRLSKKKLEKRLYTKSKLELVHRNRLSSFRSYRHF

SEQ ID NO: 22085 - protein, 118 aa, Candida albicans
IIYWEEDGNFKILQEEVKQNIFHKKIVTDNQQTDENGHGQFDYERFQSLTAKKLDKIYDVHTTRYVGVNADDDEYKEPSFYSDDVSNLELEEELLQFTTGHLRQCIHDSIDEEEMTEK

SEQ ID NO: 22086 - protein, 89 aa, Candida albicans
FSSRLEKKFFSFFFQHPKRKKKFNLMCIYLLHIVMMLQNFIITVNKFFVFAPPVNLLFCQTGILVFHHHHQTRANNTTILGRDRIITRR

SEQ ID NO: 22087 - protein, 151 aa, Candida albicans
VIYHSLWLFYYIEKLIVDLSFYNQVIATLVETYGIKHILGTPHYPQSHGFIKRQHQGIIIFFLRNYQALILGITTYPPPLPFWVDRTQVRSTTIPVPQLQLSQDELFAFLSGLINFVNVCIIIFFAKHMTAYQSQQQKIIFDKKTGRIDPL

SEQ ID NO: 22088 - protein, 143 aa, Candida albicans
GTRFNGKKLVIVDWVMNQKKMPANTSADSSPNDCSFHSPASPLQAINPPPVNSILAPAAVAAADPMNAPPAGQTPTSPLATPKPNPIPTATIQLLDTGLNLEFQIQRIIEREIQKSCCKSNECNVTYYCTTFYCFVSIECCFS

SEQ ID NO: 22089 - protein, 84 aa, Candida albicans
TDFAKSKLTLKETGIIEENRIKNLIISRYHAVFKGNPCAKTNTNDNIKTTAHNILERPFISSSNNPVLTPVLVVFISCLVSIPV

SEQ ID NO: 22090 - protein, 190 aa, Candida albicans
  UNSURE (182): Identity of amino acid sequences at the above locations are unknown.
NFSIMSTDIENTLQQSQLPQQPQQQQQQQQQQQQPQQPMSSLTKLLHESTSTLASPVLSRNTSEVTFKDQGRRTPEILNISDTVDAKSPGITIDVSKPKPSPIDTDGMNVEPQAVHGFDPSPNTKVSFLSPFSPTSPFTRQSSNSFSSNQAFQNTRGAVASPRYIKNNSVSHSSVFMGGESXSSSIPYSA

SEQ ID NO: 22091 - protein, 95 aa, Candida albicans
MNQQTEGKEEITQGGRRKLVDIKLDFFTCCCCCCSCGCVSIIKSIGGLCNPEIVQLRDRERERKRKEGKSNLRLLFGLKQEEIYLIAISILYNCC

SEQ ID NO: 22092 - protein, 199 aa, Candida albicans
FILMSQQEKSTFRSYTKEELHDLLTKLELPVKSKTTKKAMVEILDDFVEKHPEELDNIEKILQTEEDEDDDDDEEDEDIVEVVKIDGEEDEDEDDEEEEEEEAEDDEEEEEDDKDYEAPPPLNLKEWVVDPIIAQSETFIEKFYEFTDNVGITYLNQSEKLRDQLSSTVTLNYLQIGVELLIFILYSSPRIARPSSLKK

SEQ ID NO: 22093 - protein, 91 aa, Candida albicans
  UNSURE (3): Identity of amino acid sequences at the above locations are unknown.
LVXERDSEDERNTMLQTVLIASVAIVTKTKLNPYNQYFDLLVLVMLFLDDKFLEGIFNLYCYLILHKCRFAGHKSGRLHGITSRKWEARKK

SEQ ID NO: 22094 - protein, 105 aa, Candida albicans
YGKVDVRARHRNSSVLTENGITSNIPMTLCLIITFKYHTPKMNKKKHNHNNYSTNTKSIRNNTRNNKYNNNNNNNNNNNNNNNNNNNNNNNNTKSIKSKNPSENT

SEQ ID NO: 22095 - protein, 202 aa, Candida albicans
STLYFFLFNIMYTKVSPASTTTTTTIFTMHDSNNTWKQEYDPILQQYYYVNLLDNSISFDSPCEVINHKKSTTSTNTSISKSFFMPFKRSSSYTSEKDSKKQCKFTINKSTATTATSTSTSTTDNKKGSNYSLYRCLSSALSLKKTKSNESTNSSTTNTNSQSMSSDTLNESTTIITPTATPSASMTTDISAFSTAGPDYVR

SEQ ID NO: 22096 - protein, 71 aa, Candida albicans
EKKDLIDLIRPIENIYLQLSGFFFRFLNVKKQKGEKCKHPQLRERKEKNISWLPYLFISSNTLLEQSKNSY

SEQ ID NO: 22097 - protein, 164 aa, Candida albicans
MEEDNTGSHIRRSTRQQLKQQQRQQLELQQQQLAEEEEEEEEEQQIQLQQQKQKQLDQNQRTTKNQETPEYHNLKEEDFERLMEEMQIDKNDDGDDGSSDEYIFSDESDDYDDYDNINNNNNGNNKIDRPILSDEPEEDDDDEDYDFKDALKGASNFRVRHRRE

SEQ ID NO: 22098 - protein, 62 aa, Candida albicans
TASKILFNNTITIHTSSGEIRSHYKRHLVNLLGFLLFQMRFWNPVSIVSSGRSSRGATSNRT

SEQ ID NO: 22099 - protein, 101 aa, Candida albicans
KNCVWGGFKPRPPPTATNSAKFSPPCHYFSSSSSSPFALRLLIYLSIYLSFSSPAQKEQNNNNTSNKHYNHYHIFLQNFYNIELIYFLQIFMLFLLLLYIL

SEQ ID NO: 22100 - protein, 282 aa, Candida albicans
SLPPAGEDMKNKVESENQTQTQNQNQNQNQNQNQNQNQNQNQNQVNSYNPDESMMSIDNDIIPIKKQRILSPPRQLKKPKKSTQIPPITRINNINSGGSGGNGNSKLKKPSHWGDRDKSDLMYDTSMEENSLITSEINFDEPDGGGTPVARSSPPPPLPPLVSSNKPPNVHNILADVNELDLPFNPTIESLPTQVPTSKLIPPTGTATITDRDDIDNSNININGNGNGNGNANNFTNKRLLTDLKRSRSLLLMLNKKIMMNFTDSKLPLLNKQAASKISNDN

SEQ ID NO: 22101 - protein, 67 aa, Candida albicans
FLNFVYFFLDCVSRMMKLPFFYIRLVFKTNLHGYNLSPEFETPTNEKSSIFNMFFLFYLVFNKNSFY

SEQ ID NO: 22102 - protein, 90 aa, Candida albicans
VKTSSLKKVAYMVMISRYKWTRFFKFIMDLKTALFRQYLNISGCVIKSCLSDSKRLESKVILLSPIVYGMQLIQQINNKKKIKIGENAKT

SEQ ID NO: 22103 - protein, 166 aa, Candida albicans
IMGVFSIFGSKESFDPNVFEKELTSITEKINTNKQQISKLQQRQKYVRRSLSRYFIIIYLCIFGYCYATIPSSTIGKNRVQWFIRGQTRQHLLVLIGYPLFSVLTLRAVSYIFQFFINNKQSYLKSLQNKHKEKIEELKKITNFNKTNELINKFFTTALKGSALGV

SEQ ID NO: 22104 - protein, 130 aa, Candida albicans
KYTSDMRITVILGFTVCLTNAFPLDFPEWTTNAVSFFTNDGYRNSDRLIKLGPENYRIVSENEKLKLKRNKINFIDVTNQIPIESAIEQGLTLKPAPPSLWRKFQLMGSKQITTLKKKIPVYHLPKTTSI

SEQ ID NO: 22105 - protein, 80 aa, Candida albicans
  UNSURE (20): Identity of amino acid sequences at the above locations are unknown.
AISSFVRHGTYNKKLHFPNXANYIEMPNVLTMGFSLLLHISLLIQLKSPFKNMPTCNQNERITKKLMEKTITNRESSAYK

SEQ ID NO: 22106 - protein, 65 aa, Candida albicans
  UNSURE (55): Identity of amino acid sequences at the above locations are unknown.
DKFLFLFEYWFGLGTTFYFKLIYKSRNLFDIVKGVKQFLHLLDMEHITKNSISLXLLIILKCLMC

SEQ ID NO: 22107 - protein, 65 aa, Candida albicans
SKKLYQAQTNIQKGTEIYPINIKCTTAGNNLIFLGRIVIYTMEVNRYIDKVKSQVKQKKEFISYN

SEQ ID NO: 22108 - protein, 76 aa, Candida albicans
SCIFRIFWLLVVIKEQKVHIPSFVNRTRMEESNSSNYADFEPRKKGAKLFFKGHNLKNLGNRIPGLGSSSIISYHG

SEQ ID NO: 22109 - protein, 122 aa, Candida albicans
INTQFEMEVSPVNLHKEETEENKAIVQQDSETAAETVTTASDEKHAVEAGDEVNQEPAVDNDGNDKDNQSDDEQNQDEAAIDPAPQADTTDDTEKDSETKTEPGRSKRTSRKQRTRTSCCYR

SEQ ID NO: 22110 - protein, 62 aa, Candida albicans
RVLVLNFWLVVLIQDATLSFTVALNCHLRTLRKTSQTIKLTEAVANFVDARAFYVTCNQLFP

SEQ ID NO: 22111 - protein, 77 aa, Candida albicans
PCILFRIQINVAMPNQLNELEGFSFKFLVSGFDSRRHTFIYGCIKLSPKNAQKNVSNNQTHGSSCQFCRCARILCYL

SEQ ID NO: 22112 - protein, 77 aa, Candida albicans
SLEEDLNKLTQERERVKRCKRCWNGMNKRSRRKRKRSSIIVLVVVVIRYNSIHTFHTLIIYCKWFTYNDHRYLLMLA

SEQ ID NO: 22113 - protein, 163 aa, Candida albicans
  UNSURE (116),(127): Identity of amino acid sequences at the above locations are unknown.
QKMNTSGYWDQSSNNNTSFSQHEVRSQRELSQEEIRESLLLSSSITDLSFHHHHHHNHPHNHNHLIHAIDEESSNYSGSQNHVGNNLFGVGDDEEDEEEDDDDAYIEGDVRMRHSXISLDEIVYEEXENDADNIIEDQIINQQIQVIIAITTIIIMLSRTTQV

SEQ ID NO: 22114 - protein, 78 aa, Candida albicans
  UNSURE (10),(13),(14),(15),(18),(20),(30): Identity of amino acid sequences at the above locations are unknown.
NKFNECIILXGLXXXGRXTXILIYHHNLPXNLIPGKQGFGINNYLEESSESIGQKKGINPGKYGKEKNNSHHLQIPIN

SEQ ID NO: 22115 - protein, 275 aa, Candida albicans
DMPSIRLKLIQKGSNIVNDDEKTLISIFKEAMESPELFQFKDYTEATPSKDVDLIIGFIKKKHYKKWLKSINLEYRWLKKTRIYLTSNNDKDTPQKRPKELSYLKEYYFHCSLLGTYTLKLQQGPESRYKTPRSLSSIKTACTAKVYIKKPKSMPKSYLIGIMPRHNHPPIKYKGPLNTIAKNWLDEKVKMGYTKAQIKEALKKAEEQYKDSPNFKPLLQIQNYHIEYRIRHHGNNSNESNEDHSTNINDSDIDYSFIDDICDSSDYSPRVEDRA

SEQ ID NO: 22116 - protein, 64 aa, Candida albicans
KITLKRSFLYTTKSQKHEPPQWYSILLTHISSLSSCQPMSAVEERNYLYPMSEQLLNPLIAIKR

SEQ ID NO: 22117 - protein, 165 aa, Candida albicans
SRGINPICQLNCFPLFNFFFVTTRSLVYPISDLAQLPLTRSHPRYGTHTHKQKMINDNLKLLNYLFAEFKQSFLFLIHIFIYKSAIKFIHVNTQQTTPTTKLEFCTSCFTNSYIHSNGYIIQWCFFPYTTIKSGEVDYSYSKKAFLTWVILVVESFVCIRKTSIV

SEQ ID NO: 22118 - protein, 83 aa, Candida albicans
  UNSURE (63): Identity of amino acid sequences at the above locations are unknown.
KYKLLDIRVIILIHHLKNGPFYFCCRCLFFNITCILVCYNPIEIRKIEGKEIVQEVEFGFGNXPQEKNTDRVTPFLFLKKYTP

SEQ ID NO: 22119 - protein, 80 aa, Candida albicans
PSPNFGDEKKKKKEKRRAFAGQHNCSKLKNSNINITLIPPYSSNVFISSIVALIFLLFHFPTILLILPISYTSRNGCRKF

SEQ ID NO: 22120 - protein, 63 aa, Candida albicans
  UNSURE (51),(60): Identity of amino acid sequences at the above locations are unknown.
SYQFHIHHAMVAESSSIDNTPNDVEAQRPVYEPKYDDSVNVSPWNSLHFGXPQTAKYVKXKTP

SEQ ID NO: 22121 - protein, 68 aa, Candida albicans
CCFYHICYCSTGSDNLVFNNFCVNKLYDQTFVVIENKYNTSHSVHPRCGDKINSHTTRTTTRWLFTWS

SEQ ID NO: 22122 - protein, 82 aa, Candida albicans
NCFAISCLDYCTNFFVTVKYFFNECTKKKQNTMELDADNSYIILGLYACILFKRTYNTCLLYRNLKLSTCFLLFLRYLSRLT

SEQ ID NO: 22123 - protein, 65 aa, Candida albicans
  UNSURE (5),(23): Identity of amino acid sequences at the above locations are unknown.
RTTTXGNKIDKLIFTELQENTPXKKKTNTGDSGAIHNKRARQVPQFKCSFVTNYYVLLFPCVYHP

SEQ ID NO: 22124 - protein, 72 aa, Candida albicans
FQLGNFGFALLKKQSWPFPCGKAHISLTSPLLPLFFSITHQSEWEPQNPKGFKRSLYPNFGALSYIFSPNFT

SEQ ID NO: 22125 - protein, 92 aa, Candida albicans
LIDVQGISKLDVVILRWMLIDEIDFLIYKERVKQYLEKKKSKKIFSIKRIHDGGGGGKKRSERERDKMCEQKKKANYTNIHLHHRAGRSAFN

SEQ ID NO: 22126 - protein, 236 aa, Candida albicans
QSTTTCSNDNCCLQVDRLFTHDCECYYKKNLYPDEWEDDGYEGEDNAGVYANGSFDDGEWEWYEEDDGECVPTGGSSSGYGTGYWWGSGAGSSGGTTSGSSYGVSSGDSGSYSVTGGSYGSWWGGYGNDYVCPGEDGYDDEDDQTPEPECDDEDDSWDDDEECDTQAAKEVVNSVTVDAESVYPSTTAASLTTSWISTQTAQSVTQIENIGGKVYASGLFVVLRVVVDIRGLLQDI

SEQ ID NO: 22127 - protein, 63 aa, Candida albicans
SQSQGQGQGQWLTSLSSREMANPRAGSKAKAHSMAIQVTKPVAGASTLAHSTRGSRVLSSSQL

SEQ ID NO: 22128 - protein, 163 aa, Candida albicans
  UNSURE (14),(29),(30),(34): Identity of amino acid sequences at the above locations are unknown.
EFIITYPYTTITSXYTITVKPTNTDTSIXXDCSXTPNTSDSIEPSETTESIESVEPTDPTDPTDSTGSTEPTESPEPTDFTEPTESTKPTDTTDSTGSTEPTETTETLDPTEPTEFTEPVESTEPIVSIDPTDPTEPTDRTETPDPTQPTVTILPAKSTTLSN

SEQ ID NO: 22129 - protein, 75 aa, Candida albicans
IREREREKERKNYYWEKEYCSAVSKRYTTLEITELKEEVNFNTYIHLNKLYKKQYHLILIFFFYLVLFQFFYFFL

SEQ ID NO: 22130 - protein, 75 aa, Candida albicans
RYHQATVISSYSNVSQCKDQKLWPVAILLLICYTYNGCNPYSNYWRYIPAESKEIHSCFTIIFEVQSNSYIVTII

SEQ ID NO: 22131 - protein, 126 aa, Candida albicans
TNESKARKNYQSLPDHSLLICYSQLGDPREMFKLQGVRRNFQKCEKEGIVDVTKLPEEESWTFTKSEKLLEQTSLARESLMFIKIKPSSDTGSYSINNLSTETITSVTPEISGGGGGSSSSNKDIE

SEQ ID NO: 22132 - protein, 63 aa, Candida albicans
KAKRRKRRQIKKNKKSKNKVVGLFHHYKRTVLIDDSPTSVTTINTSATNNIFTTELQGPALRL

SEQ ID NO: 22133 - protein, 70 aa, Candida albicans
  UNSURE (62): Identity of amino acid sequences at the above locations are unknown.
FLNNISQSEPLALFLCCGALNYPSSFLLRQNSYNELNSSLLSLSLPMLFKLVRFLDDPKVHXSNECVMGV

SEQ ID NO: 22134 - protein, 62 aa, Candida albicans
SLMDFLPTKKSILYFSTTDTPKWNSFGTLTPSKINPNEIALHSRLNIIRIPILDHIILVTNS

SEQ ID NO: 22135 - protein, 103 aa, Candida albicans
NSQLAAYFTPGAIITEFRFPSQLHTLCIMYRGYLQYHQAVKHSLLKITIRLVKMNDSNLFICITHLVSLTNSDAMVQDYVLSALTICNEDYVIKNWNSYYIQS

SEQ ID NO: 22136 - protein, 85 aa, Candida albicans
RHKIKITFNLLVFSKAMNSEIESSLTLLKSVEKLVQATSVYKNEDNEEIFLQLKRERQENSNLHEETETLFHESLDRLMKVCHRV

SEQ ID NO: 22137 - protein, 90 aa, Candida albicans
QWHDKKSSNLNPISSTRTTSELNYIELCSSIYNQSRKHPRSVQGNKAKFRLYKNVSKKLNRKPRRLKNGFKVSRSTINCSYGIYTEDVFQ

SEQ ID NO: 22138 - protein, 81 aa, Candida albicans
NSFNNKLTMNASVKLINEIIKSSKGNKIKNTHDNTTNNINSLNTATRINNKSQLSNLIQSNPKMKQAIKLIVQHHKNKSHT

SEQ ID NO: 22139 - protein, 68 aa, Candida albicans
TFMPFVTFTMSVGGSKGLNKPKIWGQQNLSVKNSDELVMNGTENLNPELNDKFVPNLENLTTMNTREI

SEQ ID NO: 22140 - protein, 320 aa, Candida albicans
  UNSURE (222): Identity of amino acid sequences at the above locations are unknown.
HSAQWMAPAVVCEDKGQKDYSNYSNYSNYSNSSTSLGLTNNNNNNTTISPVDSTTINSHTKNSSQLNYQYHNGGSNNNNHHHHHKPSLSVSIPPPQMHSHHHSSTVYQMVTPPNLANKNSNKSNSANNNNTTTIATTTTTTNNNNNNSQLPAPHQLSYNNYFNSPNMQPPPPMKYTPGRKQQQQQNQGQNQQQPLQLYQGDNNNNGTNTNSKFNSIAGSRAXSSSSSSAVSIASSISTNNYDKYDDDDDDDNSNDLFSSSRRFMNYSNYSSSTINGSVMSGVINNNSGNGKGNGNGGSGTPISENDSPIYTKTRLCNMIH

SEQ ID NO: 22141 - protein, 61 aa, Candida albicans
KKKNSELKIVYTVTLNDNNNKQDKQDKRQNDKQLTYNKDGINKIEKKKKTLFLFLFFLNFL

SEQ ID NO: 22142 - protein, 62 aa, Candida albicans
IRRVLMEMEMSEGVSECERLVIELVRNLFKQENFFFFSYPGGKVTRPLIFLPPPPPPPPMIG

SEQ ID NO: 22143 - protein, 94 aa, Candida albicans
AVSELRLIKMNEYVNQLIGLDWIESDWYELVRKREKERKKEFFFSLVGGWCLVLDQQQQAISLYTTRIQNNTYSLYIYIYIYSQLLKIRKILTR

SEQ ID NO: 22144 - protein, 80 aa, Candida albicans
SYLKYKCKDNSNQLIVVDNDWLKVEKGDKASCKKKPTNENVGRRTRRREGGSVFFVVLATTFFVGGDNEGIRFIITNLPN

SEQ ID NO: 22145 - protein, 68 aa, Candida albicans
LLYNNLVVFFWFKLNDDNGSENSSVNTTCNHMKFKIEYELRNFFQQGMMILVESIKVYNTLIYQFGGG

SEQ ID NO: 22146 - protein, 160 aa, Candida albicans
QVMGGYYCSKFQITASNFMKGIEQLNMYPKSIYIYDMEQFQYEQDTLIEVLKKSLGTHACFSQSNDLDSETMLKFYINSNVKFDHLELSYFLNPLTLPLIATSIKLHGTRLNNYAIPGVKKLSLFQNSSGDRDQTYTFSSDLEDLYISARESIQVTLPPN

SEQ ID NO: 22147 - protein, 108 aa, Candida albicans
QTVFNISFLHTEPTPMTIINIDPDFFFEFAKLPSEVIALILGFLQKCMLPYLLYFRPIKEIVASVILSDVDITKQIERHKGSQISLTGYGGVLLQQVSNHSQQFYERY

SEQ ID NO: 22148 - protein, 66 aa, Candida albicans
  UNSURE (1): Identity of amino acid sequences at the above locations are unknown.
XIILKSLIKFHHGISRFLSENEKIRDFQNFNSIRKKIKLSPKISILILSQSEKILILKTLRYNLLV

SEQ ID NO: 22149 - protein, 75 aa, Candida albicans
INFQAINNGRILKKWAMERVFGNDGDVFNNQNFDLDGDSINKRFILLYGNNGEIIDYKIFNKSSIYYTFGIRYKV

SEQ ID NO: 22150 - protein, 87 aa, Candida albicans
IRDSFYCTGITGRLLTIRYSINLRFITHLELDTRYKIKSYTEKEDDEEEEEEEEEEEEEMESNDMTPGLYVTPITGKLLFLEQRFFF

SEQ ID NO: 22151 - protein, 160 aa, Candida albicans
ILSQFPPFLYPLFYFLLVYSFFYFIMISTLSSSSSSPLTTSTHKLENPIESQRKRYKHNMQSMSSNTHHPHFQLSKDNENNNNHHHQHQQQHEPEYISTGTSLHNTNNGTFTPITQTHSHEYLMTMGEETIINNNNNKLDIEMITEDKFFQPQQHIEKPK

SEQ ID NO: 22152 - protein, 63 aa, Candida albicans
QRSKKSGRNLPNQFFTIFVTNEVINTLNNNPMLETQVLYNLYLGGQVEIRATMIITDKGITVL

SEQ ID NO: 22153 - protein, 67 aa, Candida albicans
LYIGESFMFAQGSEKSYPLNKMFIKWSAWKLQKIFPSSRNNLNPGTPLKRLGNKPPFFLEIEIKPII

SEQ ID NO: 22154 - protein, 105 aa, Candida albicans
EFVFVTDDGSPLDEVLVPLSSVLCSSRFGVIGKGLSSLGGWCFILFEVLIGGGLVIFIEDSGVVELTTDDSVILLTAETIESTESVLVRHNCDYLTDAARNQFVR

SEQ ID NO: 22155 - protein, 60 aa, Candida albicans
RQVRTLKLFAGYSNKIIQLPSLVMFHVPFTLKCYLRINNTSRKTIEIGFYVVKLCSKMAW

SEQ ID NO: 22156 - protein, 64 aa, Candida albicans
YYYFSTIYCASLYRVLVTLVLIIVLDILPLLVIHLPLMTSPYCILVHVILRYRFTQCCVLSTSL

SEQ ID NO: 22157 - protein, 65 aa, Candida albicans
TVSFKTRIVYEQSSICFNNFSCFSIFNDIFSPCYILPKRKKKAVTHLRLLYVMIWFWMPFTLLNE

SEQ ID NO: 22158 - protein, 94 aa, Candida albicans
FIPQSRSSHFRFCFFIITMETQLISDNIINSQSMISKTLFDENTCPISTNYNYWDIQILTTFDKLTKPRSEFYFIMVYVNIILEIFFGQTFEYL

SEQ ID NO: 22159 - protein, 249 aa, Candida albicans
SRIQDITLSILRILADLKDSYGPSRILVLHGLYDGLNHQANRKQVLQYGIHDIPLLVLFEKKCEGEIYERYHQTLNLRLLLNFKLDIKSFLSTLNKFIKHNGFELLKENHQLFTNYIQDVPIEKFMSHQELGDCGPEYKALFLGITDKDIGAVLEEESQEKDLLLAKLFASGLKTTELKKFNSRLQKLVLLDDMEIIQTLSQAEFELIGIPDNEDISKLWETIKNEIQSNEYRILEECLYKFRLFNQIY

SEQ ID NO: 22160 - protein, 233 aa, Candida albicans
NSTFQFENITTIIDFHRIMLNNSYETSKTSRFFYKLKDEILGEYYTTLNLTFEKTTTNTNASINISAILDVLNPGIVQNKANYNMVNLLYHYLEITETPESIYQIVKFLSELWFNLSATRLKLQALPLHLSIIKTFFHPKVVFSKVDKDEEEEEDIIISDMSHQFGISIIENSKVRRSFLPTLTLCLSNCQIQNQKQFESCQWIPELLIKAYLIFQPEAHFFILPIILTDIYD

SEQ ID NO: 22161 - protein, 61 aa, Candida albicans
REERRKNFFTQLDLLLLFFSSLVIQSINQSINQTTNDNSKRYINLTLFYLVGINFILWIAF

SEQ ID NO: 22162 - protein, 61 aa, Candida albicans
PKKLKELIVIKIHSNKSLFLMGEIEIEIEIEIVKAEEEESRKIFIVCLSQVSTKKKVKLFV

SEQ ID NO: 22163 - protein, 92 aa, Candida albicans
VSYSITDCFQNLSNILSCIKTPSVSQLFVKLPSLSHVIRFVVISRVLHIIKWLACCLNQRGKIIETNFKINTKKKCEEINNVQSNNNPFALK

SEQ ID NO: 22164 - protein, 65 aa, Candida albicans
DIQTINTIFCNCFHEVNKETKKKTNYCNFILTCKTTIINKVDKQYLFFLYSMNNSCCCRCLAFIL

SEQ ID NO: 22165 - protein, 60 aa, Candida albicans
KKAKLLQLKTSGPAPNQESYGKKEKNNKKSLQYSSIKFTANFYGVNFCNLHISFVKTIKY

SEQ ID NO: 22166 - protein, 75 aa, Candida albicans
NTKASTCITTNKSLRIRSLGLITSSKNLSIINQIYLNKSINSICQFNTYQIWGPPKFQLICLKQQLIRLKKHNLG

SEQ ID NO: 22167 - protein, 77 aa, Candida albicans
IWLMIDKFLDDVIKPKDRILNDLLVVIQVLALVFYNCGSNIGLMVNNITQYRFAPFSYWVKVKVYMLIVFMRYNKKK

SEQ ID NO: 22168 - protein, 84 aa, Candida albicans
ITGIVVFVAIPQGFSCILFYKKIYVYTLFEIGVNGGKREVRETPENIEKKRENVKEYNVCLLAIHNYFCIKFTFRNLKILKIYE

SEQ ID NO: 22169 - protein, 63 aa, Candida albicans
FLRLFFLSLCYYTFTKSNFLKSTNHSTNQQEIHIEGYLTISFFHCIYTEHSSAELIYKNIKLS

SEQ ID NO: 22170 - protein, 105 aa, Candida albicans
NQPLSYAEVASLGKNKKQTNMAKPSKGVINKNQFNVLNDKDINTNDDSDKDVIHGKDVDNYQYDPIKSGDEYDKSKSYKLKQQKSVHKKKQLHREFKAQKLKASA

SEQ ID NO: 22171 - protein, 77 aa, Candida albicans
FIKTLNYPKCLNHLSMLVVSFLHGSRNCQHQHNQMLVDPSTIPRNFTISNTDNKLINVSMNNVQHDDDEFIDIETNL

SEQ ID NO: 22172 - protein, 70 aa, Candida albicans
GCCGLWVVVGHKLFRNTLIRESTKKIHNQMSICSIHLIFFTYSYLKFEMINKQQTKLNLIEIKTTCVYEG

SEQ ID NO: 22173 - protein, 437 aa, Candida albicans
DMTTATATPTVMATPTTTHRTTLMSTSDALITFSDHILHQIDNLQKVEYNKKGRKYRFVNNTFQRIRQEDKHLIIYPEDLNEKLSFYSAFTILYNIGEGEILQQFPSFCCTILSLALELEKNKWYEVENSSIIHFKNAKYDPRDLKDLADDYIQCHPIENHHIEWGVNLMIASKLNFLHTDHHIGTKLEGYYMKYFIESYYGEEALLSHDVLVALKSCVHWGNIKGILYKLDVPNIKIDDELKKCFDNFPDPMEELKLNVYDRYPSGTSKYSLIRKSIDILADWEFSKLIPTTTNIELDWLYNLCHEIETNPIKYHLRSKTKDLCVDPINLSELNMKFGPAINQLLNYISLIINIFNNTGGEFLLQNSKIPKLTPDLINQNLNLYNKLIQINEQIEIYLSKNWDVDDIIIRLDSGDSKNSLFTKVMEMRQKYIDDYE

SEQ ID NO: 22174 - protein, 83 aa, Candida albicans
LHHSPICLIIAFLENFQAIYNYPTPNSRKKNLSLRLQTDIRTIEKYDFQVTISGSLVSKCKTKLRKRIILLKHLFETATTSNR

SEQ ID NO: 22175 - protein, 115 aa, Candida albicans
DTPKFQVIFFTIIIIGRLMSRTRRCNKGNSQSSHFRGEHTRTHTPLVVNCSTQDNSQSVKINEQQFNKIHIPYIMEKQDESISLRQKATMKHCKFISKPSYSFSTPSSLRELFLD

SEQ ID NO: 22176 - protein, 80 aa, Candida albicans
AYLWFISQLLKLENYCFGHLSPPRIVFLPLSFPTEPLHFNVTLALDTLYFNYGPVSYVKQSCKSLSLQLMPNFELYYRTS

SEQ ID NO: 22177 - protein, 173 aa, Candida albicans
VITSLVLTIRTLNCFFLFLNLQLPPIFMTIINVNPGFFYELTKLPSEVIALILGLLPKCMLPELLYFPPIKEIVISTIFSNVSITYQTERHRGNDGAEAGYWECDCHEFCFTLVDLLEGIKKWNIYPRSIHIHNMDGFQNEPDTFVELLKKALSIHGTFYQNMGLDQETQLDL

SEQ ID NO: 22178 - protein, 66 aa, Candida albicans
EHKAELFRILFFAMFCFVLGDQLINQPTHSLTHSLTTATSTATTHTHTHTAHPTTQTQLYISYTMV

SEQ ID NO: 22179 - protein, 72 aa, Candida albicans
PEDLFVYRREIKGGNKPLLITLVVVTNSFFYTIYVCLSIYLSHLKIYRRLLISMLCSIFPTNSLQFQFPLFL

SEQ ID NO: 22180 - protein, 156 aa, Candida albicans
NLLKKSVASKPFLANHAVVYLLCDTLTIILTFKHSKMANERTFLSWIRTALVFLTFSIGFLQFYRLEIKANTNTLGDSNLLQMIQTLGKPLGAMGTILSGLTVTFGTIRYFQVQELLLDDYYPVTRFTIIILILINLSILVVLFILNIDISLFVML

SEQ ID NO: 22181 - protein, 63 aa, Candida albicans
KGKIVDSILATRLSVYVYNSFFVLATETTSPTTRKLKKRHATTSCCVLELQIYLIQDILSKTS

SEQ ID NO: 22182 - protein, 66 aa, Candida albicans
TVNAILGDVVLLFVVVIDDDKDNWALPMIGRIISNFDERGVNLDIVCNELKCITLDLHHEAGRIRA

SEQ ID NO: 22183 - protein, 102 aa, Candida albicans
YNSTDYYHLAIGSLYLFVLYYQLMIVTFNSRSQRKEGNKIDSDTTTTTTTTPITAATGITAVLTVIHEEEGLQKNVKHINGSKDYYKFKDGRSRNGCLTCKV

SEQ ID NO: 22184 - protein, 70 aa, Candida albicans
PHYHKPNQWIYKKIEQFKLPTIIDIPLFMISLFQVLLLLGKKYNILKSFSFDFKVMRNVSKTKPKKTKLE

SEQ ID NO: 22185 - protein, 66 aa, Candida albicans
LYNSCKYQQQKKKITDIQLVAEREEEDKVTCTTTTTVTIAVIVVLSITFNNFIINSKSFPKGACYT

SEQ ID NO: 22186 - protein, 68 aa, Candida albicans
RGLLYMSEYYNSKRNILQVIHTKKYFCFGGRRRVDEGEQSWNWKNITKQIKYLKRPDPPPPPLEVLFT

SEQ ID NO: 22187 - protein, 92 aa, Candida albicans
LIVKMWVENCLNFIVGRTKRTKIVDRETERVVLLEYENLFRWIKKEKNLKCGGDREREEPKLIIRRGRTTKLTVCKLFIVEKHTDRKFLLQL

SEQ ID NO: 22188 - protein, 65 aa, Candida albicans
MVIFSVLLTHLFSRFWIFVSFLLQIQEKKLLSPKSLPMCNVVTQAKGSNTNCYIMKNLDQNRLKQ

SEQ ID NO: 22189 - protein, 90 aa, Candida albicans
RQKHFITFIGLVWFFFFQYYSFIHSILLYYIILYYFVSFEIGLGLNVLALTSFSFYRLLHFIMFLLFFFLFFDIHLVIFPITLLLSSSSF

SEQ ID NO: 22190 - protein, 135 aa, Candida albicans
EKNRPFSQAMVFKKWNQLSTTTNYCCTGTHQANSGTLTNLINSKEIENLKLENTELITNLNNLIINNEKLTQTINARDQTIKSLTKINDKLNNKIDALNLEINEKNKTIELINDEVLTNQIQLNVLRSKLESLER

SEQ ID NO: 22191 - protein, 88 aa, Candida albicans
DDLCLYTDQCQPNQYGYSYFLLADNWNSKCYIFILLYNSSRLLLNFKNTIPKGQLYFYNFYLEDLSQVFKNSVKLNFNSNDFCNMTRV

SEQ ID NO: 22192 - protein, 69 aa, Candida albicans
SDSCSLVIRARNFLTAYILVGSFLDVNKLTDPLAPVPNNFPGDPYLANKFVALELIGAGLPAPKCFCFS

SEQ ID NO: 22193 - protein, 73 aa, Candida albicans
NKKLERVYYIYIYTLKIFISRMGLNSQFYFSNFGSYYYYLYQNNVSFYSRNTKYQKSNTRMKKKEKLSSNNRR

SEQ ID NO: 22194 - protein, 60 aa, Candida albicans
FFLSKNYFWFSLVSSQQQQQQQQLKQFSTLTQTNNHSNEIYSNLINWFIINHCSQCCYSR

SEQ ID NO: 22195 - protein, 135 aa, Candida albicans
HKQTIIAMKFTQILSIGLLSTIVHSAAIPDNGNALSSIIGGAKPEEIAAAGEIVKNVLGSGVLNNADVSPSVDLYTVLNALNGVAGGVITKRDEEDGQQKDGSEFEKRDVGVALGLAVSLLKLLAISVSLGGLIN

SEQ ID NO: 22196 - protein, 88 aa, Candida albicans
LKSKDCGCKCNELVQDCSVSRMIWNKKNQFKPGKRKRIEYYLMITQPPSLMRKGIFSKLLIKDYKLMATKKGKEKKKLYKQKIRKFKK

SEQ ID NO: 22197 - protein, 89 aa, Candida albicans
VMSETFPETNTPVQTPSTESFVNKMNAGDKTIGNNIFSQDSDSNQQSSHQEPLSPPNPSPTPEKRQLDDEVDNSIEPESTKPKVNIRNA

SEQ ID NO: 22198 - protein, 172 aa, Candida albicans
  UNSURE (157),(172): Identity of amino acid sequences at the above locations are unknown.
RHGGGKCVVYKDCLKKEKLKLTLKLSYVANNNCMCVSVRFFLVVSASLNFSPSIQIHINSILGSKQRKKFWPKRKPTNILTNLPPPFPKMLSPNDRNKKFFNSLTPIVLRDKPISSYASSEIITVAINQTGTRVVYSRTDRSVRIWKCLPASVVDPXTIVDAHLKAVECVSX

SEQ ID NO: 22199 - protein, 74 aa, Candida albicans
RLLDLDLDFSLSVDGILENNLASLNTLIKKITILEFISFLSKVANLVKLWKMIFLLYNMRLINTLSVDNLLLNA

SEQ ID NO: 22200 - protein, 68 aa, Candida albicans
MVIECSCNSTNILECYNLCRVKKKEITQSSKVYTKTLIAKLSTIGPWAYTCMSIDTIKIYSTFTFANT

SEQ ID NO: 22201 - protein, 121 aa, Candida albicans
MDDEDLYDEFGNYIGDSLDSSDNDDDDETQDDLFAAAQPPSIHDNEYLQDEEEVEDDDDEEEDANGKSQLVKTTTTNSNDTALVKTNIDTNQAETIYIQSQTQSLSNQPIIQPNHGKNHET

SEQ ID NO: 22202 - protein, 70 aa, Candida albicans
YSLYTFFCFSFLFFFFIMTCQEDCSCKNNEAPTTKTTATTTNVGDGPGPGPIPGNNDDDDDDIWSDDDTK

SEQ ID NO: 22203 - protein, 76 aa, Candida albicans
IIVWQFFSALCSYLYYLLVYKHFINIFPIVYMLYDSSNMSDSHHNGQNCYVVSCVGVCMRAWERKKIFLNTFKQNF

SEQ ID NO: 22204 - protein, 135 aa, Candida albicans
MICFVTHLLFCCKVLVLTHKIKHISYQLSTKSKGKKKLIVSISTTTTIISTSSVVALVVMATKTPELARVINLSATKNSGKYDCLARNFFLFRSSHLFVILIIEHHLSNTINLIQIRLNRGIHIHILHIIGLHKK

SEQ ID NO: 22205 - protein, 60 aa, Candida albicans
DLVYGKYFFIASIKIRRNNKRTREQEQEKKYSNIYFWAMQQFSDITEKKDLSGHDTTLLI

SEQ ID NO: 22206 - protein, 197 aa, Candida albicans
LKLGPCSPVVKNNNVVQVISTSSYIFSDEIVDNIFNQQSKPAKSSTKYIEVSYENAISVSQSQIWARFKNCIPNHSQNRATYKQGWSIDLGSGGNARLDFSNFLGGIGPAFKNELVGSFGIGGSLTCEINAGNHLQIAVLVKSFTVDKVKQREVKFTKFGLKNSKKKGWTFFPKFVLFDKKSLEIACITDPKFLDCS

SEQ ID NO: 22207 - protein, 70 aa, Candida albicans
HVYIYIYILMDYSFMGRFCCKHHYRIIIAKFGINNEEQQILECKKKKKKKKMHMVAWCNRISQLSTLVKL

SEQ ID NO: 22208 - protein, 65 aa, Candida albicans
NTGLIELGNFIAYLRNDPKKKKIKKDNLKLKKSLKKIVSFFILAALWSCFFFSFFLVLVTSFETE

SEQ ID NO: 22209 - protein, 125 aa, Candida albicans
LLLSQEPKFKLPIGSISSVLDIDSIDSHLDKLSLEQLKEMYGDYLPPSIASNPTKSQIMEVVRSGFFQQCEQKLSELLRGNSGAGYLMSQSLKYDYKGEGVESFFNGVRELGKKEQNDKDEDMKD

SEQ ID NO: 22210 - protein, 92 aa, Candida albicans
MYNGNKNETKLTTLVCILLRQLTLPLRSRKILTPFSYYNSNDIFKTLYKKLLKLILYNKENELKRQLEIQPSLTTETIQGSTLSLQSVNNIQ

SEQ ID NO: 22211 - protein, 71 aa, Candida albicans
INLFEFMELHFFCNTLIRDNSKAVYNNQFNNTFIVKLFSVVSRVSKYSDQIKQVITRYFVCNYNSIIINCW

SEQ ID NO: 22212 - protein, 82 aa, Candida albicans
NQTPEMPNNNTNLTQPTCTRYNSLICVCCVGLCKYPNYCVIIPVEYKPPREENNYNIYYNFYTAWVLNFENLEKQIGMLKAY

SEQ ID NO: 22213 - protein, 88 aa, Candida albicans
NLLKDTQYSLEQDESFKQQIYTRNIETSDFFNLSQILQYDCESMLLLRDYRPFDDQIGLTRSTLSMDVIKDYYNDKTVILDSLFSLNR

SEQ ID NO: 22214 - protein, 387 aa, Candida albicans
KGLSQIIGYRTVKLIFFVNRDFPTCDVTFNCLDRRIFRRVLPENVKTKVAADFSFHVVLGKNNLLDHLSDMMLDTPTTAHRNVFSESFLCLGETIILKVFNKRQKILGTYSRSELNFISWLNKKCLDRHGFCQEEIKKLIASFHKNLGKITSWELEKQIHLGAYVSYLLNFVVLMLKFGAQAYFDSSKGIFQSFEAFLAYVEKYTILPSTTVDFLMNNIQYNIMSINVPSYPPQFLFEIESNLRSLEFVFIRPTVFKDESINERFQKIEYHFKSLLKFFSGYVLPIVYASRDENSVSIYPPQAIYEIFQEWHTNVPSETMSHHQSIDANNPLEYEFLYDLSSTLYMYYYAVAAAFDAIVHRVYISLLRQLYIAHKYTLSKHENIDYK

SEQ ID NO: 22215 - protein, 176 aa, Candida albicans
AIIKVSMLIIHWSMSFCMIYLVHYTCTIMQLQQHLMLLSTGCIFLYCVSFILPTNILYRNMKILTISKDHYYLERLYPFKVDILLQRHVFYASSIFAFFRRRFCFYHNYTDWYSPFDDRLKKNRFKSRTIRNSFEVPIHSFNNTLIHPEHYPLRDEKVALESIEGYPIFTRAGRIV

SEQ ID NO: 22216 - protein, 78 aa, Candida albicans
VRAHFLYVHTPTLHKLIIPISNMKREREMKRERDIKLNYTKPPTFSPPQQKNLPIRKCYNLMSSSIIHHHHHHHHHHH

SEQ ID NO: 22217 - protein, 66 aa, Candida albicans
IIISMQFLFTFIFLLIPLVYSLPAASPKSGTDFDFNQEIETFVEQAFNQDDPSQAAAASSPRRLEG

SEQ ID NO: 22218 - protein, 103 aa, Candida albicans
NKKTEKEKENPEAEKFWNTFLIRKLVDFMCINRDKNSHCLIGTHLFNISSLGGYLHRYTLSCIIIYTHTLLMYTHRLFFTGFGLNLIGIVIYFTTSYKLYELS

SEQ ID NO: 22219 - protein, 142 aa, Candida albicans
  UNSURE (31): Identity of amino acid sequences at the above locations are unknown.
VVSLQDLNLFHPPHDLGSIFGTKSVKVQINXIPMYRTLQGFNNIPQKLLVDDDINFPTEVPKAKKRKHSHHKNKKNRSSKDTGSSGFTLATATTPTSFISDAASRFTSDTNSKYTLDSSLDSPQTGGESSNLNSIFNSSPIR

SEQ ID NO: 22220 - protein, 394 aa, Candida albicans
  UNSURE (53),(68): Identity of amino acid sequences at the above locations are unknown.
FMNIFIRVFIVCFRPWSKFHGISPRANPADDVNNTDPNLKRISQFILLGAAEXTGNRHHHLHDGKSAXSYESSLDIMSVQNNEELKDEFDEFIEIPTLVSDNESEEIESIATKTSAPHWKSQLSLQPTPATSQSGSNREGVQAARFNVQSANNHQHQPVVHQHTSIQRANIKRGILATRKNNQQPAITVDDVKQSINSTTTTTTTTTTASTSKQSSLECSQEQFKLERTKIMTIVIKYVTAKIHNSFPPDSGRNVKQNELPLDKFLLILTSRLRITLPVFLKAIIYLFRYMDIIYLLRYLNQTNNFVNYNDMGFELKKLIVGCLKLAIIKENRITKNKYVLNWEQITGLKNQEINSIVKTLVGRMNGKLNIKDVEVANMKNEMFRFVKMISTQV

SEQ ID NO: 22221 - protein, 60 aa, Candida albicans
  UNSURE (36): Identity of amino acid sequences at the above locations are unknown.
KILGINTSYSNLFKGLTFRGLTTKLTKRLINHQLGXKGTHPNQGTEFLIWINFKSLLRLG

SEQ ID NO: 22222 - protein, 71 aa, Candida albicans
QFFYRYIYKCVEKYKMQRNDSISNKLKMFQFQLERYTSLKQNINKETINPNKKTSNHISLKERKLFSILEN

SEQ ID NO: 22223 - protein, 101 aa, Candida albicans
KNCVWGGFKPRPPPTATNSAKFSPPCRYFSSSSSSPFALRLLIYLSIYLSFSSPAQKEQNDNNTSNKHYNHYHIFLQNFYNIELIYFLQIFMLFLLLLYIL

SEQ ID NO: 22224 - protein, 328 aa, Candida albicans
IIIKRIDLSFYQAYKKTTTIEDNTLKVSTFPLSNLPEPLVFGITIADAELVEPESALGDGTTESVAAGRAPAPLLDPLLAPDSLLEPSLDPLPVPLTEPKSLLDPLPELLLEPLSELEPLFEPLLEPLPDPLADPLTEPEPLLDPLPEPLSVSLFDPVPIPSPEPLLEPLLEPLLEPLSGLEPLSDPLPEPLLDSPPEPEPLVVPLSEPSLEPLPEPLSIPLPESDPLLDPLSVLEPLLEPLSEPLSEPLSEPLSEPDPLAEPLLEALPDPLLEPLSEPLLNPLPDPEPLFEPLLDPLPDPEPLFEPLLEPLLEPLSEPLLDPLPESS

SEQ ID NO: 22225 - protein, 126 aa, Candida albicans
NHLIILVPSKHVDIMILITINTCKYPIYSSSFFLYHHKTTTQLTTNHNMKFSTAALTLSLFAIVNSSVTTYGAGFGGDDDDNSKHHKYDCEIDTYEWKFALAVKEWKHCQDNKFCQVLTSRKRSAS

SEQ ID NO: 22226 - protein, 197 aa, Candida albicans
  UNSURE (194): Identity of amino acid sequences at the above locations are unknown.
YYQIVTGPILYELMMTTKLSPKQLLLQLSEKLSSSNGRDQLTYDEFAQLYYKVLTILSNHGDTNKVADDENNKPSIDLITPLLNFINLNVNYGQKDTTELIYILARLIWYYVHHQSLLNVDVLLSVFTSLPYTQFCQTNHILQSDTILNYVDYFMLFSFDNDISNKTNEYLKLYTGFIAFVNRLIIHCLNDGPXGPS

SEQ ID NO: 22227 - protein, 61 aa, Candida albicans
TLEFLVLLPKTSHTRSNFFFLNLLCNRHQILFYYIKEMLLLFIYTLILLFYIGVKCKRSLQ

SEQ ID NO: 22228 - protein, 92 aa, Candida albicans
KELGRNSKSKGREEEKKIKDYESFFPFFLSTSTLFIFLIENYKRRGKIDLKTHKNKQKNERVRSLSKITKFSYYLISFVSKIIMINETNGCS

SEQ ID NO: 22229 - protein, 83 aa, Candida albicans
KLFFEIKQFTGHPKLIFHYNNNVTKEVEIKNIKQNEIIKTLTEYSQRSGNELFKFNHKVKSINDSVRGIWSPLQVPKGYRHKI

SEQ ID NO: 22230 - protein, 94 aa, Candida albicans
MNMYVCIVVVNERKENEKKKKKKKKKNNWGREGKGREIDCLCIDSEFSFIINFFAEYFTPTVIQSINAAHHGGINLLFVSFSLFSLLALTNQFF

SEQ ID NO: 22231 - protein, 67 aa, Candida albicans
NLLLIVIIIVVVVVIVVVDVNQRILKLKGGEEGRQDRSYQMVGKGETKTRHKKLKQEIPIMTKCAIP

SEQ ID NO: 22232 - protein, 96 aa, Candida albicans
  UNSURE (50),(52),(60): Identity of amino acid sequences at the above locations are unknown.
ISQTLGLKLLTIGLTEKLSSSLAVFYQQQFNTLLQNLGEEKVFEWRYSNXYXNKNIEGLXNLLQMSPQYYLMLHLKTPGKARVFFFLVNERRKEEG

SEQ ID NO: 22233 - protein, 61 aa, Candida albicans
WGMDLTNTKNFHQILLFFLLGVSQDDTTIQYKCRTQNRISLRPITETDSKLLEKHTWPQPL

SEQ ID NO: 22234 - protein, 93 aa, Candida albicans
HGVKINNKRHHDISTQFIHSAVIFSDTWVKLGVDVVACRVSLTLERSRNNKQNNNKLIWGGGDGKKEEEELSERKGDKRQRQNRREKKNKTFF

SEQ ID NO: 22235 - protein, 106 aa, Candida albicans
RSAGDILTALNQSNILVPTIMKITENQNLGTLVKTLVSRIYASGLINDLPLDTYYEYAKKENILSDALQYILTDPTWSPGLATFFKRMDDAGAYQRLQDNMYGIKK

SEQ ID NO: 22236 - protein, 93 aa, Candida albicans
SLCLPFFHITTTIFSNIMALSELEKKRQENIRRNQELLKKLDLDSISDSIKKEVDNKSFSSPSLQKRRKTTKKPVIKKEILEPSRRSRRIAGD

SEQ ID NO: 22237 - protein, 60 aa, Candida albicans
TGYKNRSSLCGWAKKIPNQMTNCKETKLENALTWVSIGFQNTPITANGKIALKLRRRFII

SEQ ID NO: 22238 - protein, 89 aa, Candida albicans
EKKKKRSQKKKIILLFNQQQHYQVLSLSHITILIPHTSHFIYYLYPHIIQVYWYLFFRCFTLFSVHSFIHSFLSLFFLSCLSCVCVCVC

SEQ ID NO: 22239 - protein, 89 aa, Candida albicans
CKPRQNHLENRVQVQHTYRELIKLINDNLSRNTIDIPLVHNFAPKNLELEQQRFKIPSNFYKEPNYSLSITDEMEFFFCESIKNEIPLV

SEQ ID NO: 22240 - protein, 137 aa, Candida albicans
IIFPKQFFFFRIHIFSSSLAISTIMARSGKRTNNTIFRKSLRIQEQKKYAEQDSDVKRYQELLKKDLEKDIPPKRAKGKRKARKKPDDQSVLAPIALPQRPKFASARKSKEEVKPNYSNSNALPPSLMQTTTKSFGK

SEQ ID NO: 22241 - protein, 178 aa, Candida albicans
  UNSURE (127),(138),(151): Identity of amino acid sequences at the above locations are unknown.
KKKKKNPIHEKLSTYHKFEPLKLDMTLLLVFVIGVAVKVVEVPENLFPQIEPLVGVDTPILHVFEEIGPVVTKDGELFKKLVLVGVIEAPINGDPLLLLLLLVDKNKFGGDGFLLAFGGNKIGELLXEPTELSNKLVXKTSGSSSTSSSPXKNENEPEVCLTTTPTTISPILNINLVK

SEQ ID NO: 22242 - protein, 61 aa, Candida albicans
EVKNKPINNKFNTKLPNCLKKKQNNKTTKITVKYKTEEKKIESIRMLKSWKIKKKKKKPHT

SEQ ID NO: 22243 - protein, 299 aa, Candida albicans
LKEKQLSIVKRQLEQQKKKLSTLFKFFFFFIQDNYVYFFFGVKLFQAMSMDTISISKLIKKSINQKLPPKLFISLFNKLIKKQSINNEEFINELLILDYDQHTCSSFSSLKQHKWNEYKQTLIIELSFSNVENNHLFWNNLNQIPNNLQCKYLSKITKLLSHQSQHYDKEVLKNFIKNEIIDYVMKYTSITSITTTTTTTTSKVSGNVLENIVLLLSVLIDKFEKYLQEDTTNSFQNFIVKLLSSSNLLSSLVNDDGYLTNYLLNKSKIILSKNQYDQIVNVNNMVRTQRERQSSNRHH

SEQ ID NO: 22244 - protein, 81 aa, Candida albicans
RHQEMTMREYVAPSQQEQHQQFHNDVIGNGQHQHINGDNNNRDPHTPGFQTNFIDSAFNYLNLQSGIDMNEDIHSLFHMMN

SEQ ID NO: 22245 - protein, 60 aa, Candida albicans
  UNSURE (6),(7),(8),(10): Identity of amino acid sequences at the above locations are unknown.
NKFYGXXXPXPGEDFQPRNPSFPPAEKGLFKEKKERAIIGGLRESLSEEVRFFLEFEETP

SEQ ID NO: 22246 - protein, 62 aa, Candida albicans
LLNGYSNQVRMEINKTRGKNRKKKRNFFVYTESGILTCSAMKGEKEKVRQRAFSPGGQDPRL

SEQ ID NO: 22247 - protein, 75 aa, Candida albicans
SFPLPDFTIIIIITEIIPKVIHAYIFDSMIVRTALNDNLAKIFGSANRKLTVFRSDCFPFCVVLLLSFISLISSI

SEQ ID NO: 22248 - protein, 61 aa, Candida albicans
SFKLEILQGGRVRVGEEAGEYSFSVGAVGAVFEFLGGKVKFKKELNKPELTMELELYYKAC

SEQ ID NO: 22249 - protein, 60 aa, Candida albicans
DSSRMKKTSMECLSEITPGMLDREKANADRKGSGSTEGMDKRVSGGLEAGFEKENSENEK

SEQ ID NO: 22250 - protein, 170 aa, Candida albicans
RKSFFANLTRAKLFILLFTNKRFILSSWFNRLIISINNSSGSDNSLLLLLTIVLCAGSEFSLERLTIRYNKISINTIESNSNILNKSVISKTGLTNKVGSATNEANMVPTTAKSGSNKVSKSVISNKGLNNKVGTTSIAPSTVPTNATMGSNTVRRIIPPIIQWFELKNS

SEQ ID NO: 22251 - protein, 66 aa, Candida albicans
  UNSURE (59),(62): Identity of amino acid sequences at the above locations are unknown.
AQQHPATTASPAGLPILNIYLRFFPPQNGQIYNGSNNMGELLWVNSHEIPPKDCTTRFXSLXPLGF

SEQ ID NO: 22252 - protein, 121 aa, Candida albicans
LPTMIFKIFRVILIILSLMCCILEIFAVTGSYDNKKYLTDTYLINFHIDSLDLTKLIDSSRITKRDGVGSKMVSINPRQGTPTKRAPAESGWYYVPGGSNTQSGPSATASSGGNAVASGSA

SEQ ID NO: 22253 - protein, 103 aa, Candida albicans
LPSPFLYLKQTYTKSKKRICKSLSKGNFNPGDEIGESKTGFSGYRKNSEFVLVIRKKNGKQEERKKMACLLQSEKKKLLIDLQNQTATITTHHPPPKKYSSYN

SEQ ID NO: 22254 - protein, 168 aa, Candida albicans
SFNLSGDPSIPVVKTLLVAVIVVFNIYIAATNVFDKHISNHASKQLAVKLTQLDVSTILTTGTLNLNFKNNEQFQVNNGFKLPTFKTIPTHNKHKLPNKPKYLVPNVPYDELSFKDKILFKLNEVDFNKDKDWLKSQELTSHKVEVHVNEFTQEMWDNNPGLFFDPRF

SEQ ID NO: 22255 - protein, 60 aa, Candida albicans
METILETKMMFLCLLWDLLSFGPMAYGNALTKTLDKSEITRTQNQSRKKKLYFFKVKKKI

SEQ ID NO: 22256 - protein, 73 aa, Candida albicans
WSLKCKMSTLSYFPCMFFIVEPLLLLLLLLLLLSGLKDIQQCMLMPKKVKIYFKSPDTPTNQLVDDTNTDDVD

SEQ ID NO: 22257 - protein, 77 aa, Candida albicans
SSSLGYDTITKYYVKNLVETKRIQTERKAALKKNKVCIRAKTLLQQAKTMGMENYEICADYFLMSRGAGSDEINTYK

SEQ ID NO: 22258 - protein, 60 aa, Candida albicans
  UNSURE (18): Identity of amino acid sequences at the above locations are unknown.
GKKFSARILSSEKGFPPXFPKLRVQMIQLRKRENFVEKYGYPVFIKPPFVGGVGGMRVVS

SEQ ID NO: 22259 - protein, 60 aa, Candida albicans
SLFFYVYTKKKKTNKICILMLEISLIHLFITCSSFSYCFLTRGCPFHRHFQNHVGLLHSY

SEQ ID NO: 22260 - protein, 282 aa, Candida albicans
  UNSURE (8): Identity of amino acid sequences at the above locations are unknown.
CGSAASWXKTDLMFYGLNRILGNNCDFLKIDSVIPKDHDHLNNYLIVIPQPIPFDIETPHQFRIDMNHEYHLLILRIKIAELFLSLIITKQTFDFLYNKEHFKSLIRVIGFEQNHIAQSPRSKHVYLRLQLISMLVKIIDYLTQDLRDASELIYSELMYEIFVVFLRIAFGADSLSIDAHKLLVKIRNRPGGKSLTVFNKWCETRARQLNHVSILNFNVETVANVESDFANGLEFPYESETVELARNILNRFVDHDEAENLYVNMNAEDPHDFENDDEMDIP

SEQ ID NO: 22261 - protein, 191 aa, Candida albicans
MSESITITANSIYNPETDVRRNERFHLVPRKRLEALVTTSGLIGAMIGFYDGVKISSLRYLTENAHRMPKTVGGWYFYHKKKNYVMIVAGVKRALTTSFKYGAAVGGFFGLEYLLDISRGNTIDFFNTTTAAFLTSTFYAIYNKLSFMQTRNMIFKGTALGLTLGLIQDYLIHARKGRVWYLDRYTQQKLV

SEQ ID NO: 22262 - protein, 64 aa, Candida albicans
NIYTTSFTNYSYCIVLFELDTVYLKFYVVLDKLLWRVIYANEKRESKRGKVTEQKKIHYVLHQL

SEQ ID NO: 22263 - protein, 103 aa, Candida albicans
TMNYTKKQKEAILNHLRLERAKVPKRNEISKKKLADQTSQKVLRRLNGVSVTLWDIKLKDIFQVERSKKLVAKKLVRDVQDMRRKLLLEQKESPLKTTHTSTT

SEQ ID NO: 22264 - protein, 63 aa, Candida albicans
SGGPSSPVVKIRSRSQIDIEKRIYDIIGYDIEYKQNPLFLFSLFYLQTYYKLLLYLCLPLIRS

SEQ ID NO: 22265 - protein, 606 aa, Candida albicans
RGEDYQIQVGGYIVLSTFSIFYFPDDQIQYMSTSSEINDIAIIQSHVKLHCIKELTKPGNGISEENYVSFEIIDKSRFLIIAESGRSYLLFTDMEISSKTTIIINQMTMVSLGEVTIPYYNGLSHIAGDLFFQSSQFSRSVLFLVLPEKPHIHIRAYIESSPPVLDIKDGCGQGVEELYTCQGSWEGSELRKYGAVQHTPELLETKTIDMQIERLRIVNSTVMVYNIDGDSVALETHNLMPKITHLKIELNVLDYYKDPGFQCCVTRLSLLVNGKTMVNESFIYSSVVPEISTVVAVSDTKSIHVQLKNYEFAFESEKLKEITSIDAIHVGNGALLILATDWSGDYRIWKVVNKKAKLIYSGEMKDQTFVLDSAVVQSGENDIIAFMLTNNGSLHQLLIHLTEKRVDNVNFTEQYVSDVPCFLRKYKNNVLVFNFKHLVALKKDELLGFFFKKYIHVPKLPLADVCFATEEEVLIGYQNGRIDKVRIVLPLQVVSHQSLFSNKLYLKCLPVPLSKFLVGVVLDCSKDSINTQLHLVNTDSFENLSIFEFDEPLGVQVVDICLIQDWQNEKAHKDGLFVCLTLLTEFPLYVFGIEESRIFTTREKSK

SEQ ID NO: 22266 - protein, 126 aa, Candida albicans
  UNSURE (5): Identity of amino acid sequences at the above locations are unknown.
NPRLXFPVVSGTPPTTTKATISNDLDLDIDIDRLNNQLSISFNLLNLNLQNLKIGNMINQILQNKFNQLYKFQFNKSTDNNDVVDVDDDVDDIDMDMNIYKLNQWYDELNHVIVPFIIQDFKDGWI

SEQ ID NO: 22267 - protein, 61 aa, Candida albicans
NLKIDKDREEKSNKNRQSLKKSKKKRKGNKERKKLNNNNNNRKRSRKINTKYIFKQYIIID

SEQ ID NO: 22268 - protein, 116 aa, Candida albicans
LTFLRYRYEVILTDNKNNNIRRLLVYVFFSLVVPAFSVLDAKINNNNNNISLSWCLEIVGTFQLLRFGSFKRVVIHVLCINLTYSFLSITRKIDKLQFLNSFPYLLVKNLSFGQFS

SEQ ID NO: 22269 - protein, 82 aa, Candida albicans
ITTLLKLPNLNNWKVPTISKHQESEILLLLLLIFASRTEKAGTTKLKKTYTKSLLMLLFLLSVKITSYLYRKNVNQQQQQLQ

SEQ ID NO: 22270 - protein, 187 aa, Candida albicans
  UNSURE (25): Identity of amino acid sequences at the above locations are unknown.
PMSDNDLKHALTVTPLAHLVPTQAXHALLCPLTLPQVEEPYPRGKTIDVADEEVMKLLGKELLEYDVDMPIFFKEYFKTGGTSSIPLNETERQLLAKNTVPYCTKVTTVQPPRLSVRKKYNATEMDHHNRNYEKKFSKELKELNVKRQTEHTQPTTRKLVKLSEADIEKSTTTRIMLLLETPTPQSF

SEQ ID NO: 22271 - protein, 84 aa, Candida albicans
MEQMSRRTTTMNIYIYIYMIELEVNIQKHSVKVKVSDFNFSCLQKLKAKKKNFCMVYMQEFVWRYRSFKIFTTGLDRSALDSTN

SEQ ID NO: 22272 - protein, 98 aa, Candida albicans
KGIKLLNARSPPFQQHQPEQISTLPPPPPAQVQPVQPVQSVQLPIQAQSTPLPKPASISPLPITNSYTSMKFKFMPSKSKVTRKLQECKALGDITNLQ

SEQ ID NO: 22273 - protein, 65 aa, Candida albicans
IPFYFVQLFMDWSSCQVNTLDNVRHNLINGMLIEQRVITHIRRKENKRAASNQPTNQPPFPRIKI

SEQ ID NO: 22274 - protein, 237 aa, Candida albicans
FFENTVINFFLHNEIRHQHQLAFSVLQTIAEITTIKTMERVFDNECFTSWIKIVFEEVENLPNLFISLSNLFSKHEEILVKLMATKIKPSDEPYSIEDLRLKAMKVCKRDTTEISSFMATTLKHQFKDLRMYSINTITPITKVYLQVLLEYFQNTPAMNEALNTLSSILMLKLNFFDNKDTRIVIEFLFDSYFNLRLLLEDYMLYRFDSIELQNHRIYQDCFKQYHKSSYQQQGPDD

SEQ ID NO: 22275 - protein, 72 aa, Candida albicans
LVANLYYIVSSYCTPLTTKNCYHGTNLILPGRVTILKKPLSEKEEEEEKKKKNSSGLFHTQRLINPTQPNQT

SEQ ID NO: 22276 - protein, 269 aa, Candida albicans
FSGITIMNHYPISSSSTSSTSILSINSNNYNYLNSITMTKCKLLPTKTISRGKFRGINDIRRFQCYNSQCNLNFNEYQLCKYCAHVPYVSLPLRIKVKNNLNDDEEYNTGRTGNNNNNNNNNNNNQYRSIKIDYIPPTRSNAIIRRNSSYINNNNNNNNNNKLIVPHSVTTLGTTNSNGNGDLTSKLNEFWDHLEMGKLQIKQRFMDIKIQKHKLSFKKRSFSAPPMVLGNDNDTTTNNNNNNNNENIYYSTGTSTSDYSTTTTTTTTR

SEQ ID NO: 22277 - protein, 447 aa, Candida albicans
  UNSURE (447): Identity of amino acid sequences at the above locations are unknown.
TYTGDKDIITDITHIHTTTHTHTHSLVMNSIKPSTPVSSPKAQKALSIVVQEPRPQPTTPPPPAQKRQTTFSSRQTKRLSSSFLNTPEPQQQLSQQLSQLSVSGVRDKELNLDSQIPSLPYTPSSKRRSYGIFESPVGRSPYGVALRTPRNEDHDSPEQRLKRYGIVERDNDDDDDDNEYEDEETRHNYTPMGNVGDDEDEESRRLKLQKTPQFHSAKRLYDTLNSVMINNQNSAHNRYMNGIINSGNGQSINESTTNDSGSNIINKSPNLKTNRHSWSANVNLQFSPSKAPLPPPPQYQQHKLPPPPPPPQPKFTPLTTSNRQPQNQEGQFSPPPPQQPQQQPTTPRSSWSISSTPMGVGIASSSISPVYLPPQSSPTKLIIEPNDEEVSAKDAIRKIIQKKRHSGTTSKTNPRTTTTTTTTTTNNNADTVAAAAMTLNFKSGGHX

SEQ ID NO: 22278 - protein, 69 aa, Candida albicans
IIFLMASFADTSSSLGSIINFVGDDCGGKYTGDIEEDAIPTPIGVEDIDHDDLGVVGCCCGCCGGGGEN

SEQ ID NO: 22279 - protein, 87 aa, Candida albicans
GCSLIMLCINKKKGGKRENLLIMMMGRIKNKNLNKAQLQSTTTKHNNAKKKMSLINRHNNNNKSLIVHFFFKPIDICKCTWSFRLTS

SEQ ID NO: 22280 - protein, 99 aa, Candida albicans
PLYSVVVYFYSHCGSYMCPAKPSQFVKCANPLRNMCVCPTHPPLRLLKMCINYLTDDCYNFTVQEQEYPLQYSRFNILMPINSTFIYVRSFCFLLLALG

SEQ ID NO: 22281 - protein, 74 aa, Candida albicans
LIMDSIITINMPRDNMELDYDCQKHTKGPNLLASITPQNTKLLTELGMSSPQQTSILHEATHHKFIRNTSGKNI

SEQ ID NO: 22282 - protein, 110 aa, Candida albicans
NYFMNSQDHFKDDFEGEFKPIKYLPKRKIDKEESSINSVNSSANTKRNKKASLVIGIDDDNTYLDSPLDKTKHSKTVPDGQYDANDHAITLPEAVEDDIESFTTGMEGPA

SEQ ID NO: 22283 - protein, 87 aa, Candida albicans
QRSVNERCLLVTQFYSIPTTLLKSSTQQISLYCTTYILNQNEDVLLFNCFTPKGRIITRESCTLASFDNEDKLGSVKYQKKKSKSKS

SEQ ID NO: 22284 - protein, 160 aa, Candida albicans
TTFIDRPLLPTDLFEVYFFFDCNLQPIHKNIKIKVKCNKSLYNSWLDLYMYKKLLTMFQGVTILRPLVAYSFIVGNKRQKTLSQAPSFETTINVQVEIRIYITGNMFLVNKIESSSIRKECLLGLMYRKALYNEYYFIKILYINQARDEKLFIPKRIVLR

SEQ ID NO: 22285 - protein, 61 aa, Candida albicans
RERKEKKIDIIKPVSSHTQRFEKLLQLTQNRNMKAEEKKECVYKFFSYNEMRFDLIHRILQ

SEQ ID NO: 22286 - protein, 96 aa, Candida albicans
GFLFIRLDRLFSYNNTTMKVPPEKPSNIGTFSPQQGYSTDVHVKTHKYSDKPTPISPNQNKAYGYVADHLDSDHRKKYAKEGGKKLFDILLGIICR

SEQ ID NO: 22287 - protein, 82 aa, Candida albicans
SMSPGKWSATIVISSLALERFNSKAVVNPMTPAPNTTTSAIDINWNCCYQKCRGKRKTYKDKIKSGAQSTNQNDLSNYATKI

SEQ ID NO: 22288 - protein, 64 aa, Candida albicans
LDLYTFELYLNLDSIVESMTESILNSLIVLYHQREFLIFSIAIGANNDISFRLFFFFFFHIFVA

SEQ ID NO: 22289 - protein, 92 aa, Candida albicans
KGCSYVFSFQGGGWVFTLYLLGVEKLTLIVEKSKYVGKENLWRRFAWANFFSVFFPCIKLLFYCQGSIMYVESCVYTEKKTSINIRTTKYTK

SEQ ID NO: 22290 - protein, 283 aa, Candida albicans
NQRFHHSTLLAYPTKLHSASTSLQIGKFAKGKFVCEDEIKVVGEIKSILQSKYPVVLTEDNNAYLIKKKVQKLSDAHHIQLLHYREKDYIVAISDNLNFYNDGKLENSISSETALEGVLSVEDSLVVFWSGKNELLFKKIDWSDDEIVIPRGELLMNGTKAHIKVAKPKVYKTDATSLMKKLSGISDHAAIVGLCQSVGDSTVIKEVSKEIGLELFPVISDAVSKDTTNTNLALWFKWIYLIHGKHIAKQDIAPVKEAKTQLELGVKLMSHLIAIQGKLQLLK

SEQ ID NO: 22291 - protein, 87 aa, Candida albicans
HVLNYRHDKFELLGELSLLDGIVVHSVLLLVWLILEITPECMIQRQLYSNITPIFCSAKKTLPPKHLHRDRVGPPLQITTNIEQTNK

SEQ ID NO: 22292 - protein, 132 aa, Candida albicans
NSPQNTNIHPNNANMSKRHNKTDSVNLGDPLPLTYLPTRRQSPSPSYHRQHQQQLRQPSGSLQQSTSIEPLPPPTTKPTTSSLLSRLANNPATQPLPHVTIPRTPTTKDRIKNKLRQLIHELNELETYEEDN

SEQ ID NO: 22293 - protein, 64 aa, Candida albicans
ILTRESIETGSHNNLIKKKKKRKLETKTNQISESKETVLFTKAFHQNPAYLKFSAKYKYSSQQC

SEQ ID NO: 22294 - protein, 113 aa, Candida albicans
RRQLIIMEQQLNDISNHLIRINTTEGITNMHEQEIDNEKEEQEEEELLNSVKTNILRLRSQNENQQQGIYKLLCTFCYKQKYLILGISILIISFLISSLIVADFKYQYCYYFC

SEQ ID NO: 22295 - protein, 79 aa, Candida albicans
SNQNTNMSLWGVYTGPQPPKKPLQEMTQEEQAEERARQMIGFMNSCPGKTVMAGVSGFALGGFFGLFMASMAYDTPIGN

SEQ ID NO: 22296 - protein, 63 aa, Candida albicans
SAATTAITPKAPAALVNATEPTKYDADNNEKSAVRQRKNPLNKTVLLKVSNIKIKLRIAQAIK

SEQ ID NO: 22297 - protein, 314 aa, Candida albicans
NIKVSEIFQTDDKPNTIKQIYKNLVNYYLDYTNLYYEIKEKEIIVLVDCDDFYLESMDHLARTYNVNDGANGSLNDNNILLDLITRCSTDIGTEFYEDSLIELNKFIYQLYYKKCRFLDNEFERFRVFENLYILLNHCQNCPHLKFNIYTFNSSLIFPKFYKQVILKNHTLQLSQTKSIISSSLKTSIEKILFSNHSLPSYNFFSDIFINEIVSGCVSNHELSHIYGDTFRELHSKLDHLVNVNCFGIMFEFYHGERFLEIDKIYQKFENRHDLITNTKFEIYFDKNFDKIKRVMNEKVKLVLCKIDFDNSKIT

SEQ ID NO: 22298 - protein, 62 aa, Candida albicans
RNRMKCWIGLMKRSTTRPAKSSKQDAELRRYYSNLFTTSILSAIDPIRLHYGRAGPNCISRK

SEQ ID NO: 22299 - protein, 82 aa, Candida albicans
YVDPPISISWGIVIVDIGYSVKKKLVCGAYFFFPSCISAASAMIAIYKSTSSSPSFFFFQTTKTNEYIPFNTRRTIVQYRGE

SEQ ID NO: 22300 - protein, 157 aa, Candida albicans
LLSTNPHHLLHPFFFSKPPRQMSTYHSTQDEQSSNTEESSQDAAPRPVSPSEVPADDREATQLELQPLLDPDDPRVSPLKLERIRLLKVIATTLVYVNLVLFVVLLVSQFFAIPGFNNRGKSFLGLDLALVSLFINLTTNCSLRSAYHLHHEVEDPR

SEQ ID NO: 22301 - protein, 79 aa, Candida albicans
NNGILHLSSATFLFSFDSYYDNDRVKSRLRAESANNNKNYKKKNVYPKLDQFFHFQSVIRRTVRMNPINYCHRNKYYEE

SEQ ID NO: 22302 - protein, 66 aa, Candida albicans
TIGICSLKQPTSPKEGLKLKSKFVIYNNTTEVVERFHWKMNCKIITKTILLRRSQQKHQKIICSYN

SEQ ID NO: 22303 - protein, 69 aa, Candida albicans
PSLYQNKELLMIIIKSSSSSSSSSRSISVKVKSHRKKDPEIPRLKFFIETSHITHTGGILKKVRTIKDL

SEQ ID NO: 22304 - protein, 60 aa, Candida albicans
FPRIACYNNLIQFLLLKYNNPGVLNEFRGVLKKNKKRSCKGEVRIQYIVFFEYSNNNNND

SEQ ID NO: 22305 - protein, 379 aa, Candida albicans
LYAHSATPTYYSQPVSYIMSTFITTLDEEINYIQDLLQSIPFSSDRTTHFLKVYKISHQELMKLNEQPLKFPVDANKLLKLGISLGNLIRTLQIDEESYQQQHNQQRQFLQNLNNAKNSGINSGNNSNNGTRVSSTVSDPFRDSTILQPPPLKHIINSNNSSNTNFLSPNVSQPPYQIRFIKNLVNILKNFDIGPRNDFVQSSATLNQSGNNNGTTNRDSVSSNQSIFYTPQRVMSNGSNTSSANMSPIKLNSKQLLIEKLENNINLDNLFIYKITLKLILEIFHILKQNLINTTSKLNDPSFAMTPTKYDFDESSSIFSLNSSTSQDSSLTNDEYYKLLSVAILRISHGIVQPFVILIYREFAETKISDDFTQLINSL

SEQ ID NO: 22306 - protein, 91 aa, Candida albicans
SSVTTAQFIIITGQMVLESLRIYGDFVFFSLIKKYHFENLNQRGKWTDFLCNNISKNPIKTQVPTKSTTFNNYNNIYTHFCILLSTYCTRF

SEQ ID NO: 22307 - protein, 97 aa, Candida albicans
INLVFLLVNNQLITISVGILGTNHHIGEIYIQEGEWLTEYFPIQSARRKHVNSVTKLGPGKIIIVFMCKVFFYFSFVIFPAYCGVYIYYTEMIAFHF

SEQ ID NO: 22308 - protein, 92 aa, Candida albicans
KNEKYKRMLSLTNMTWEYLLKKFDVNDVITFDLKNSEGAKDLVSVNIMDTLQLKEKILYDLRHNFIDVVDYCSFYSSLENLLNELIKYIESK

SEQ ID NO: 22309 - protein, 165 aa, Candida albicans
LIIQTKEVTMKSGLLLAVILPVAFAVKKDQQSCNTSCVKVLQKQQESCPSGSDTDCLCKLSDSDYWEPLADCDCINPDKKLSASEIKVQICGAPSSSSTPTSSTETTSSTEAETTEAETTEQPSSSTSSNTESSKTTILETPSIQKLNAESTTSVITPLTESAVA

SEQ ID NO: 22310 - protein, 73 aa, Candida albicans
KQKNKSQKNTDSTAPFFSPVKLCPTNISFVYLNLLLPVMRGIILLSFVLTSCLAADAVPAAADAAAVTTTTPA

SEQ ID NO: 22311 - protein, 81 aa, Candida albicans
TGKPRTFFRSIFFSSIAKFFIFAFSLYHFKRVLSHSSAFSQDIASPELNKSGSIWLFFFPYLRIYVYLERFYTFEVLAQPI

SEQ ID NO: 22312 - protein, 277 aa, Candida albicans
IKLLYMYSQSRNFHNHNTHFNECMFFNPETPQQICPRVWLGPYNALINKTDNYDSNFLVEHNIKIIINCGTTLQFLDLIENNRDVSVPSDVLILSLDPFFQSHDELAVNFVQKYSRILTNYLNYFYKSNLNAAKLIEQLPNSTDRIQISSRILCGANLMMQFFSLIKLIDLFKLVNQEMEVLIISQDGNDNLLTGLMIAYLMDTYRYNLLNSFNMIKSRRPSIYDWSSVEYDALLKQFYAQICETNCPTSMDTIKRSPQEDDNEVLAGGDRKRRFLN

SEQ ID NO: 22313 - protein, 65 aa, Candida albicans
NIFFVTYTLKRGNTSGYLIKSIIISFFCPLYIHITNDLKYQLSCTNLYQGSCLKDQQDQELQRYK

SEQ ID NO: 22314 - protein, 64 aa, Candida albicans
YERCETKIYRFERMGDSTGGCRRWKSYCQSYFWKITWCIVSKGITYTPINYHHYQVKAGGKFKQ

SEQ ID NO: 22315 - protein, 60 aa, Candida albicans
CTNKKTISFDCKIQNQNINKLLFSCVITIMTNQEQECNNRKKYLILVHEFKHLTKESRAM

SEQ ID NO: 22316 - protein, 62 aa, Candida albicans
YISWYFRISFEQIVINLAGSGSFNIYVFLRFVYSKKNVINSKIINNIWFKKCHFCSKIFQLL

SEQ ID NO: 22317 - protein, 74 aa, Candida albicans
GSGVGRHVKSIVPSVTKLKEVDERNSGRKEKERNSFYDQINKILSTIVKEQWHYAIIYCIIKFHLLDKELEGGK

SEQ ID NO: 22318 - protein, 61 aa, Candida albicans
LVIDCKYWNLISFQLLLIKKWYESAVLTHASTRLNRRENLLYIFSRSQGQRRYPPPLLRRK

SEQ ID NO: 22319 - protein, 85 aa, Candida albicans
WKKKLIEQIIIKLTSLKNRRDRSKTLLVFKELCQACTSLRMSRMIPLRIYNNQVWGTVPIILLSFLNPILSRIVEHPNSVVFNIS

SEQ ID NO: 22320 - protein, 76 aa, Candida albicans
MQKRIVQLTNSGDKFAIITDTCQYSYTHIRELSIWSKLNKMTLKKGDKSKLTITPTVVHYLPPSNSLSSKWNLIIQ

SEQ ID NO: 22321 - protein, 95 aa, Candida albicans
HISCSHCKLKKYFTNYREIQFFTIISFDATIDIILRKYLEFFKVIKPVQNKNNYAYTNDESVISIPYLLGDHIRSLILVGDMYLDCVFTPGWRYA

SEQ ID NO: 22322 - protein, 118 aa, Candida albicans
  UNSURE (12): Identity of amino acid sequences at the above locations are unknown.
LLSVIESCRTFXTGPDKKYVHSQDPNSKVNQQLQKAQASYEKSGIDQKLRKYFEDAAKLPLGLKIHEYYKSFAKDVTDVHQEAVRLANIKKRELEEKKQAESGSTTTETKDTSIPQVQ

SEQ ID NO: 22323 - protein, 91 aa, Candida albicans
IVVLVVVAKQPKLKRGILQRELEIERIIRVGNTPTNVERFSLFGFAKWYKVPGIYKQENTIPRSMGLVIFPWQVYLVGSGEYRVFLISQSY

SEQ ID NO: 22324 - protein, 192 aa, Candida albicans
VLIVFHSFFSFFPFLTFFFLYFINRDLPIIIKDILLIEDLEMFESDLSFYLALLILCCPISIVFFKKFPIKGYTGANKVSLFLQCLIAILNLNILYSFINSLTITLGHDGSSANTLTIDPITTTQQQGHVDYTPIKVSGYTFKNQVATKNLQCDSIVYDQDLDLQVSQAVDLNKPEDLKIFQRQIKRTPFFK

SEQ ID NO: 22325 - protein, 239 aa, Candida albicans
TNQRILKFFRDKLNELRSLNNIYDLFFQDNEDEVEESILERKWYKFCGSAVWLDKYGVYFMVNRIAYSKKGTRNNPTISVLAGQVFDKNWIELTGKKFPFSGLEFPTILPHYIDEGKEAEKVILGAEDPRVILHEYTNENGIRIQEPLIAFNALSTEVDWKRAMHIYRPLHDPHRIIRLSIENYAPREKEKNWAPFIDGNNLNFVYNFPLRILRCNINNGDCQKVSGPDFNDKSPDNAG

SEQ ID NO: 22326 - protein, 92 aa, Candida albicans
RKCQPSPACCQLFRLWGTWTRTRRKKNYLSNKLLPAYEIYNRKYNQLVWQRFMKIRLFPYTYLLKRIKCKIEVKYVKMGIKNSNRKHLVNIS

SEQ ID NO: 22327 - protein, 162 aa, Candida albicans
TMETDKMDIENEKYRFISLDLYDNKPEKEVKKVLVKQTLLHSPIITNIITDFKVRINKPFKGVSSESFNDEEFQTLIPQEEDSQLDAFGDSDDDDDQLLFGVSNDTTVTLPEQSQQITPQFKTVEVIVKHTSIVVDGIEFSTKSAIRSSCVVKSSTNEDEHH

SEQ ID NO: 22328 - protein, 87 aa, Candida albicans
YCASSLSSINIINFYTIMKGVKKIKKLYNYYAIGLIISLFSFVSGMELYSYLSVRQTSLFATLYREPTKFDINLLKSTNYLGAIGNY

SEQ ID NO: 22329 - protein, 136 aa, Candida albicans
NIMFSPINIKFINKEIGRIIDNLSNKGVIGLDFKFPSFNHFNSHCITSNSLQLKMQEFFSTLNIPNTKFNFKTEREGQTIKIVDVEHIQGEAGPEIVDMFTSKKQQLLKRMTNLDVDKGLINCNLIANVLYGETNF

SEQ ID NO: 22330 - protein, 62 aa, Candida albicans
IIGIKIHDNVGNISNTRLYGIPKQRSISIDIILFTIINNTTTTKKKKKNNILNNTVGDYGVL

SEQ ID NO: 22331 - protein, 92 aa, Candida albicans
LQPKTGKIEKKNNNNWKNNTIIKISEILKLSKLDSNYIRQQFSPPLLHTLFLTLLFYQLCHLIDLGFRKIFYYYYQTRDILILKCRKRIPLW

SEQ ID NO: 22332 - protein, 76 aa, Candida albicans
HKGERVLNNNFRSKMENNFNKQIEPYHKFLLTYLPSVWKTSWKNHKEHIGIVIVNIQNINSPNSKLLSMMYIIEKY

SEQ ID NO: 22333 - protein, 491 aa, Candida albicans
  UNSURE (38): Identity of amino acid sequences at the above locations are unknown.
LPSKIHGLSIQFPVLFMILLIIIILLKILHTNKNYESXESLSSVLKTPNNPEDDDGLSTKPPLSFQDYVFNHTLATSNTTVDRIFSNSTGHLVQCPLYYNDSIVLYYEVDVNDHFHKLGSYSVLFKVISNEEDSKIIGCSKAYVTPVQPKVISNVVAYGVLVLLMVTLLLNVITIMYSTYQESSNPFLFKASAICNEELLKQVDTTLPGIFTYLQYALFMGGLDLAYPGFFQPILGQIKWCALIGFSPVFKNEHHSYNHSDNVYYTLETGGLPNLTRYISNDLIINNWANFIVTFIVVIVMHVVLSQLFIMSKLLLDKLDLGNSRSKKLFVRGGDFNGFSIFSKKNFYLILGQVLHLFLLVFAMPFLILSSFQFLSASDILGKRRFGTNYAQLREDAYSMVVPYNELCIPSSIFSFATKICDGSEYSPSKYPPIFDSGHIMHNTERRNYVSSQLSQDIMYLHPNDNATLFHNTHHIGNYTQKVDPSYMRIS

SEQ ID NO: 22334 - protein, 60 aa, Candida albicans
  UNSURE (13): Identity of amino acid sequences at the above locations are unknown.
PISAVPSSSRREXKKILGRERQKKEEEKRELKNTRRLKCRSCLNFSRQWFYESLMKQQTY

SEQ ID NO: 22335 - protein, 89 aa, Candida albicans
LFSSTNNQLLLVLNGAPSSRSIVKYRPSPVERRDLQEGLVVHGIIHRPKLNRSTNIDQEISVIAYGIFRPRASKFVVSSKIHKTIVVKN

SEQ ID NO: 22336 - protein, 188 aa, Candida albicans
FSARGEDPQYVFEKNHLRGLTPVKLPLASLRFLDVCRCDLTSISPLLSSMKEKGKENTPLNVSAVNNWYLNVRDVRRMLKLYKNFTITVSTFDENLIDTCRYSSRLSCEETHYNENPEETDYSDENGNSDEELYYGSQDLDDGFDEDYDFDDNFGFNGYGGFGGPGDESPDNVFLEMFRAMMRDGAID

SEQ ID NO: 22337 - protein, 152 aa, Candida albicans
IAVIMASEETDIKLFTRLGQLPDDVIALIISYVPKCQLQPLLGFSPTKKAVVKSYLANVKITECQDLIISGTCNQSEHRDCQDKPAAVSLKNLRLLVKQWNLYPKTLYFTSFKELGAMLDVFPEVLINAEGINGVFDKESSGNRVQNIKQLT

SEQ ID NO: 22338 - protein, 556 aa, Candida albicans
GALFFLPDFFTRGPLHFVAGDLHIYQYILPGRIHLLKNLHLLPKDLLLAKVHLPTEESSSTEGPSSSTDSSTDITSASSTDEQSSSGTGQSSTEDEPIDSTESDTSSATDSSTATDSSATNTDTNSESTDSSTATDTSSTDSNTASSTETNTDVTDSSTDSNTGATESSTATDTNTDATDSSTVSETGATDSSTATDTNTGATESSTDSNTGATESSTATDTNTSATNTDTNTGSNTATNTDDNTATDTSSTETNTATNTDGTETNTGATETNTDTSASNTDDNTGSNTATNTGGTDTNTDTNTGGTDTNTGTNTGGTDTKTGTNTATGNNTGATETNTATNTNGNGTNTNTGATDTATNTATGTNTNTGATDTNTNTNTGATVTNTATNTDNVSTTKDIPSPTSTNEGSNNGGGSNNGSGSNNGSGNESGSGSRSRNGSRDGSNNGSCNGSDNGTGSCNGSDHGTRSGYGSDNGSRSRSCSGSRSRNGSRIGSDNGSCSRNGSRSGSRSGSCSEHGSCIGSNNWSSNGSRNGSGSSSENGSCSWIRPPNLETGFW

SEQ ID NO: 22339 - protein, 112 aa, Candida albicans
FGPRIPLTGVRFPDSWSPFSHTRYHYQNPVSRFGGLIHEQDPFSELEPDPLRDPLLDQLLEPIQDPCSEHEPDLDPLRDPLREHEPLSEPIREPLREREPEHEREREPLSEP

SEQ ID NO: 22340 - protein, 82 aa, Candida albicans
  UNSURE (76): Identity of amino acid sequences at the above locations are unknown.
FLSTMVLSTRVSIQWPPKEAEEKTSTLALTTPVNNYVDIRIFKTQYPCLNSTLPLPFTQVFELGLAAKEICLKRRXWKLLVG

SEQ ID NO: 22341 - protein, 88 aa, Candida albicans
SWQHILLLIVDTTKQYVLEFNLLTFSELGSYKIAQIAVLESRIFLSKQIVPLKKKKAKAKKIFNSDSIFYSTLTPSPSTHSYKTNHVR

SEQ ID NO: 22342 - protein, 63 aa, Candida albicans
LGRWVGRWMMMIFLVMVIIREDRKKGTKKGTKKEEEGGEEEDYCLLFIFIDQKLVVVVFFVDL

SEQ ID NO: 22343 - protein, 101 aa, Candida albicans
ICYQKKQITHIFTLITSNASHIVLVLVFVLVFHFHINYINFDDFIFCIFLFLSSSLQSTTLIPPPFPFILHSSFIYIYILTYFHNILHIVLYIYILYHNLI

SEQ ID NO: 22344 - protein, 75 aa, Candida albicans
KNLKTNSIDPTFNYRTSDVPFTVSGVDYNADSILKSIGVIISEEIIRIRILGENSTQQNCFVFKTLYTDTYSSVK

SEQ ID NO: 22345 - protein, 79 aa, Candida albicans
KKTASFEILRSKRKNYFFLIQTPDSKNGLDTHMANYKEFLHFGVCVRQEKIFFPQISRFNISCGDKEQETDVHKLTSRV

SEQ ID NO: 22346 - protein, 74 aa, Candida albicans
SSEIYPTHNHITKKFNEVSLDNTELPILLMRSQSLAWSSLVFIPFSWNARNSEYSQSSSPLPDRILFIFYTGKL

SEQ ID NO: 22347 - protein, 77 aa, Candida albicans
VIFHRKYLAKTGVNVFSLGSNELYIIKYSILVAPNYFNTNVSNFSSTSGNRRTQTSLCERLISFHLNVLSPTKTLID

SEQ ID NO: 22348 - protein, 77 aa, Candida albicans
LRRKKRRKTITVLWIEFTYTENTHTYKHIHIQKSNHIYIHKLFYNASLYMCIIIVIFINVHTNNNNNNNNNNNNNRI

SEQ ID NO: 22349 - protein, 113 aa, Candida albicans
YTHLSMNLLNNCDEVSSSSSKTTNNFNNLINSTTAEPPQPQPQPQGLSTSTTTTSVSTRHHSPDIVYSSHTKSTLISKAPSDFIQTQPSSPEPTSSIQTISNQITDDLPNQEV

SEQ ID NO: 22350 - protein, 61 aa, Candida albicans
TTFCKKKNVKKIMKGARFELARSTDQQITLVKKDLNLHLKSVTLDQLGQPSQFVVKKVCGF

SEQ ID NO: 22351 - protein, 66 aa, Candida albicans
TGESNLLTTPFAGQITDPLKSFSLIIIHFLLSLRYRNPPFVIDHILQKKKCEKNNEGCEIRTRAVN

SEQ ID NO: 22352 - protein, 180 aa, Candida albicans
ISSLRIQYNQIKSTYQENMIFTQVIIVLTVTSQALSVTISDVNNIASNQVTKRLGGGSRGGSSSGSRGGSSSGSSSGYSSGSRGGSSSGSSSSGSRGGGSGSSSSSGSRNWGSNQYHCSGNSCGYGNYYAPSTAAAAVGYGTGRYTGGTQYGNNQYHCSGSTCGYGNYFASPTTRPGRSR

SEQ ID NO: 22353 - protein, 75 aa, Candida albicans
RYTINEQVEPKTEALAINGQPCGHPYIIPVKNDNAENPINGGNPTINTKANIINDPYFKLCHSSDKYMRNRIICI

SEQ ID NO: 22354 - protein, 66 aa, Candida albicans
AEDMVLTAPQPTQATTLIAAKSLVVRSPIRNFDNNICLNPKADPKHEKNATGNPPSIEKKIITNTA

SEQ ID NO: 22355 - protein, 202 aa, Candida albicans
SFHSYSFFLNYIFYLWFHFKTHSLVRYNCIMSLFRSLQNSPSTISIFHNSSIPLSNKLYDILEKAYDTQPEKPKHEFQIDLMKNKMPTYDQYKLIVDKYLKGSTSKTILHNCFPFLHDSKTELYNSKGNVVTVKGVEWANKTFSPAEYQMIYDTFNKLQESSDQSINTIASNVFQAPLVVDWDNDVIAGDEETLKAILSKYN

SEQ ID NO: 22356 - protein, 92 aa, Candida albicans
VVVVVVVVGLVGVLFFLLYIVWFIIPSCLFHNNGQRYMRYKIRIRIVKVKNNEIRFVARIYNNTKNRTEEEVYVQLYHSTARQIFAFSLFCL

SEQ ID NO: 22357 - protein, 87 aa, Candida albicans
QSRNINFFFFSVRRAPPPLYSFSFSSSTMYSLLKQSIRPNLLVAQQFRTMITAQAVLYSQHGEPKDVLFTQNFGDRRREINSEPSCG

SEQ ID NO: 22358 - protein, 88 aa, Candida albicans
  UNSURE (15),(40),(59),(62),(63),(65),(66),(76): Identity of amino acid sequences at the above locations are unknown.
TDCKESQSSKNFMLXLTLRVQGVSHSSTKVGFSGSFEKFXKGVTYKIDSMKFVAREKKXKGXXRXXILNMRMSIYXALNKGSYTGKLV

SEQ ID NO: 22359 - protein, 105 aa, Candida albicans
YRSQLLEMNISILNFINYPGYSVKQRERGGNYLFRYGDNVCSLESSKLIIPCNFHYSAGRGIGNSFQYTWTENFSASEKSQILSPSSYSSNHRLHHERLEASTSA

SEQ ID NO: 22360 - protein, 63 aa, Candida albicans
RGDSFDNYWWELNGNNNRKQHSLEKLDIYSNSCSRYGGKLFMWVVVIVVVNRKIKKRNTDNKK

SEQ ID NO: 22361 - protein, 99 aa, Candida albicans
VTSSKQRKKTKTSEPLKQISNYSKYMTLDDLQQHGRERDSSTVDHEIHRKPRTSHKSGSRMSSIGRVLSRQSLNNNNSTFEKYLDDVDGSDEGAGIEEK

SEQ ID NO: 22362 - protein, 74 aa, Candida albicans
IWWLMVPCLFCSPIFDSLVIWDILQKNLLLLKCSFYLSLDDERIIEEKKNNNNRLRRKKMGNNINIFNTGSNFN

SEQ ID NO: 22363 - protein, 68 aa, Candida albicans
GGIRNKVFSIKFILTYFAFRNCTLVENVFLYELKEWERVTNCTNFTNVEKSWNRNMHALNTGHHIYME

SEQ ID NO: 22364 - protein, 68 aa, Candida albicans
SNLVFIRFGISPGAKKKQKEKKPCTKFNVCIYSYLKKKLMNNQWETAILTPFPTEYTFGKIRSESVEH

SEQ ID NO: 22365 - protein, 200 aa, Candida albicans
TFLDKLVDSDSDSEVDKENENVIQEVDKSKNQEQNDHIITELDNTEQSVAGNTKSTTNGTSYSEPENNNQVNQESVTANLDSVARVPEPEVIENSESEEEQISKITHNTPATSVDLSNGPEETSYKIDLVLIDLIDDDFTFSSDTEGDEVEVIDAVSPEVCKLPEKPATPPIRKSLGVKRKVNKTPDPESNSISIPSSTT

SEQ ID NO: 22366 - protein, 94 aa, Candida albicans
KSHNEVTRKVVQDPSTTNKKSLGVKRPRPVSIIDQLKRQKIRSQVIVSRETQSIIEHESRTQSSLPSPRNMLDEISEIDVIIDLDDDDVFNRRD

SEQ ID NO: 22367 - protein, 213 aa, Candida albicans
FLFGVNTEPPNGIFWPIGPLLGERKKKGVMNLFVALSKKKKYQHKLFAPYLRPLTDTTTTETRFMLSTCLIRNCVFIRPRLSVICFKAIRYQSKKLDFPDYTKINDPKLREIIEGSNFGTEAILKKQREDQDKKKKMEQERKRLEQEREVDRRREEKRAKEESESNKTDNDNEANQHTDDKLAKVNEKLESNNSKIESVRPRGEDLRLIRQDR

SEQ ID NO: 22368 - protein, 309 aa, Candida albicans
YVSAAPSSNSSGVPAAPSNNSSGASVVPSQSANNSSASAAPSNNSSSAISESVAPSSYGNSTIAQPSTSTKSDAASITGPITTDKVITNESGIVFTSTVIITHVSEYCDQTSAAAVQSSACEEQSSAKSEQASASSEQVKVITSVVWCESSIQSIESVKTSAEAAHKTEVIASCASELSSLSSAKSEAMKTVSSLVEVQKSAVAKQTSLAAVQSSAASVQLSAAHAQKSSEAVEVAQTAVAEASKAGDEISTEIVNITKKVSSGKETGVSQATVAANTHSVAIANMANTKFANTMSLLVANFVFGGLLI

SEQ ID NO: 22369 - protein, 211 aa, Candida albicans
INRWPKDGTAQFITTIHSEEHVGVHDILHHIEPYHQEEIQKNDQYNLEKDVQPPNNELHISPFEHQEHDHAPEHTPLNIPPERPELYGHKFVEPERVFDTADDYFPTHILQEVEKINISNKPDTEAEVEPTSASELATDVTAFNLMNDKLSKEGAIEESAFEEIYTEDNEEIDGEISEDDILEEEEEEVVPKLFPWEFRESGKVVAERVFD

SEQ ID NO: 22370 - protein, 75 aa, Candida albicans
LKLTINQKNGNENDNEYKKQRNQKTRQDKTRQRCNAKCNIKVITTEIFSDIFFHILLILMNFNQTLFQQPLYHFL

SEQ ID NO: 22371 - protein, 62 aa, Candida albicans
KILPRKKACFVASVRKKFWGIFGLIYVFIPSGKVGGKNFKQFTKPSKKYMDKDDCIFPTPKS

SEQ ID NO: 22372 - protein, 61 aa, Candida albicans
MIWITIYESLELDLINDDDTLTSTKGISYYRLCIFIQLYLHEVNEIIHKIYKIFWNTRMIY

SEQ ID NO: 22373 - protein, 79 aa, Candida albicans
TMVLLKEKPRTIGTDSDNSIYKDIEQSITPPSDKNEIFIDQINNDRITEYDSHGEVKRDLKPRLVNLDHRAWKIRSMAR

SEQ ID NO: 22374 - protein, 64 aa, Candida albicans
SIKISFLSDGGVIDCSISLYIELSESVPIVRGFSLSKTMVQQADKLNTASFFKKTKNTKVTNLF

SEQ ID NO: 22375 - protein, 65 aa, Candida albicans
TELKKRQNKNNFLVNHTGGLFFFIVYHLSFKNTYQPIEMIHNLCNDHQTKNRLIRSALFGLAVTK

SEQ ID NO: 22376 - protein, 72 aa, Candida albicans
DQNEIKSNEIDLPNARIVASQSSKEVHLYMYVYMYGLFFGLPEESNTQLESIDTINNSKEPLDELASNLTRL

SEQ ID NO: 22377 - protein, 78 aa, Candida albicans
TFVNLPLIQRLLVNLILANCGKTPKNAPSKSNAWNQIQGPLFNIVTLKSGFFSSPIQKIFGAIINPITKFRVIERIIW

SEQ ID NO: 22378 - protein, 86 aa, Candida albicans
TSISHIPLIYITMQEGVQFAAATNLKSRNKQGNGTAAESPSLSPQISDHSNDAGNKSNNHYKERLSPFRYKLRSLILPLIRQETIY

SEQ ID NO: 22379 - protein, 61 aa, Candida albicans
LALRINFLSLTKTVPIGAPKVFDKQSDTLSKYEQYSFNEIPVSALAFQILAPSKCNLTLFC

SEQ ID NO: 22380 - protein, 103 aa, Candida albicans
LVFKTNTNNMPYTFNFPKLQSSFKYSIKSLTNSRSFPMISIYVTPQSTPKFINNQSIDKMTVLSSFRSRNSFIIARSILSKLLRKNKADFQKFSPRRGRTHAR

SEQ ID NO: 22381 - protein, 67 aa, Candida albicans
FWKLEKENAPQITAQQESANNSAVVLVHSIEETTESGKKSIENGTKSLKKSIANITGLNLDEEVSKK

SEQ ID NO: 22382 - protein, 483 aa, Candida albicans
IKDILQVYTMKYQQIPKSIRLLCDIYKQLSNKPNSVYHPQVGKYLSQTNDLNLIYQQWQILTNNRKKGDSIKNITERQFYSPSISFGDYELSLIKKLFIKPTKNHFSFITGLPLEDPIFSLKSHDKNRHGQFINNIENNLLSYYSPFTQYPQNSKSQLAYKYYLRKFDESIPIMIILKKKYQMFSIFSMNHWDKIYLDMKRRTRRQNMLTNVDDLTIPSRRNMMKLSQRPFEFTSINTIDLFKLALGNYNDFKSLLNPTTIFLNKFNLNKNLQIAPWNGNEFTSQSYNNNNNNDDDDELIKMIDKNCRVEIRDQSTGDIILPDDSKLLEYVNKEKSYVKQLDQDEVMDYSQQIPYQLNFDKYYMLNILNFDSGDTRLSSFSRILNTATTTTTTTTGGGDKNSSNSDISPSDLEIVGVRLSLDNPQVNRMINEMSDIKLNNKDDDVFAYEDILKLVHTPKRNVLRSLMDILAVKGIIKVRQSAD

SEQ ID NO: 22383 - protein, 62 aa, Candida albicans
LTYFVFSFVVSYQDIFYPNDSLKKLKTFDIFFLKLSLLVLIHQIFVNNIYKPIEILNFEDIG

SEQ ID NO: 22384 - protein, 63 aa, Candida albicans
MKIVAKISIKSFSSLDDVIGKLGPPVEKSIVLFAIGGFDLVMEKNRRQLIPPLNNALKISTSS

SEQ ID NO: 22385 - protein, 202 aa, Candida albicans
RESFQPRGEEWYCPVVEDLNLSTTTATNVDVQKVTKISHDGTNTIEQISSNKFKVIVQLPNSGYKPYYRNHSPDDLPQVALGLEFENPDMAAQFEYMLAVYDARFKYELQLYYYDRMVYAVNIINFKTIMQEQEEEEEEDIHELTEEFKNQNITDEFSYYEKTSKELEEFEKENANKFDHDTNDDDDGNDDEDDDFGDFIAC

SEQ ID NO: 22386 - protein, 153 aa, Candida albicans
RSESGMNKFFRRLTVNSPVVRNNYFIQTDNNLDWSVSIGSENEEKIGWYTADESDDVNKLYFRSERQSLRRLPISGAIVFTIRTYFLPVTQLCEEPYIPRRLLNGIQSWSEDVGEYKGFHIFKDALLPYLEKKALEQEANGLDPTKEPQVYPF

SEQ ID NO: 22387 - protein, 100 aa, Candida albicans
IVGRIKYFRFYTFEDNTYKKNKKATYYYSDSSKPMNINGYIIHKHLTFSSHSPTDLFIIIMLKFLPEDYRLYLAYLPDLQACVNLFMTFTPLFSYGSTCY

SEQ ID NO: 22388 - protein, 66 aa, Candida albicans
YNVSKELSIAKGRTINLYIKCTSTETKYVSQKINGCIIFLYNRLSDPVSSASRLQNKHTLRINQFQ

SEQ ID NO: 22389 - protein, 94 aa, Candida albicans
KMSVDKTQNDELNIHKSPKDLTSVTTKTTENLDLQSQADEIFYHDSRLSLSLSSRLILMISLVGVIGTGLFLRYVCFAVVMHYLRGHSICYIKK

SEQ ID NO: 22390 - protein, 65 aa, Candida albicans
PSHLIFFIRHLSQACETRTPEDVLISLKLEETFFSSDFLFFFDMVSSIFVNQKQGLCLYRINGMI

SEQ ID NO: 22391 - protein, 148 aa, Candida albicans
VIMEVHIDPEVSKHQEIIDAITSATTALSQRSPESPASQQHTELTEKEKHSHKDDELGYEFIDAEQNKNEPTGNAEEALHMLLNEHNADREIFEDLHLSHSDTQKSPNVEDNESKPSEVKLVSYDPDSKPPRLGRPRRNITNTLAPPD

SEQ ID NO: 22392 - protein, 67 aa, Candida albicans
FCTLINILQILGFLVNSQNMYKSILMLLCIVKSITIYIDDIYLVANSEKSQLYCSNFLTISSYDNQL

SEQ ID NO: 22393 - protein, 297 aa, Candida albicans
SFAKPTFEDLGIYIVIWISCCHSMDSNSFITKGEGDQPLPYNSTVDESILNEVSSENNELTPKLSRELNDSDDSPKRKKKKRSLLDDDFFSLAGSFEKRKKKHKHKHKQKEKEKGIDVQDQVIENDGLIEVPIPQLTKVSTDKEISSELASSQSDIPRKNINTVQPEISLLRSVSITPPLVDRNKIRKEVMSRLNKEHMRSKIPDMEDSEEESDHELEELLKLKSQMPKSQTESSPETYTFDDESEKKRKYIVRVTSKLPAVHNQTLEVDFGTKGLKTFEKILKAAVDYFKSFITRC

SEQ ID NO: 22394 - protein, 134 aa, Candida albicans
VQSHCNSQHSTMWKPQKDKTFRLKYTSQYGYNVDHFNFLNDYKEDWNDYVAYVNESLVEKYSSRSRKFDSIPLNKLNLDDTKYDSTDEDYVRENFKYTNPIALKSNSSTTKVDLVPETPVHCLNRREGGICVDQ

SEQ ID NO: 22395 - protein, 159 aa, Candida albicans
CLKTIIIGKLIPTTNNVAENLREMELNGDKFLDRAHEQTNFKKRGKKSKHKNKKPLALKKDKGNKSKPLKEEDVLSSKDDNDEEVSTITPISKSNDLEIIREIEIPHDSSRNQPTTIPIDYFGLIPSISNECCLICQYQAIYGTEPRHNEKMLRSTSSR

SEQ ID NO: 22396 - protein, 93 aa, Candida albicans
FVSTKQYMVLNQGIMKKCYDQRVHAEEKRRRDFKKKLQNAKLKVLKRQKDWRQKEPEQQQKQKQQQNVNNGIDSDSRTQPNTETLANRIDEVD

SEQ ID NO: 22397 - protein, 74 aa, Candida albicans
ALHFFMTISKIHEQSLLLQYEFVDLNNLLGVSLESDYENTFITALVGICSYEEAGYDVTLNTNKKTTIVATTIT

SEQ ID NO: 22398 - protein, 128 aa, Candida albicans
CLTINCGSARPVVKTKKLTNELMVLYLHPSLEAIIRQPILNYIDSPTPKKSPDGTNRKTITSDISKTPFYSRLIPSTVLLDPSSLVLLPPSSDYNQLNQYLQIDESSESAYNDLLELDETNKYDYWIE

SEQ ID NO: 22399 - protein, 72 aa, Candida albicans
SKHTMTCHSATHTRLYYSLFGADDLHTRLYIDNDLILLCDLLPNLVTTLIANQFYKNNVQPYVTVQYYYHKL

SEQ ID NO: 22400 - protein, 87 aa, Candida albicans
KYQFKEKTKINYHIIIINLYFFKSIVQNIYISYTIKVFIFLLYFYSFLIISLNFNYYIIKKIREITKERKPVTFLHRRDGSSSVREA

SEQ ID NO: 22401 - protein, 73 aa, Candida albicans
NLSNKSSSGLSIYEDCYLLFSFFFFNLFYSLTFGCIVSFYCLFPKEAILLHQVEEEKYVPFRKLKKRFFFFAT

SEQ ID NO: 22402 - protein, 60 aa, Candida albicans
IRDIHKNGMQAYESFFDSISISKLEHNIRNLFLRVFQKRKFTVDELAPVVLCLCLLHEIS

SEQ ID NO: 22403 - protein, 84 aa, Candida albicans
SQYSMNGSILFWIWHYHFCSRYKGEVFVKERNQTKVELVKLLIKTEKLKNKTKQNKSKLKLEIIKKRRVINHIYINTISIGMKE

SEQ ID NO: 22404 - protein, 412 aa, Candida albicans
FNQFNLCLISFFHENFTFISTAKMVMPNPKEYTAIHGVLRLLTYLNNYPAEGTGTLFLSEKAKNLMGPKLPQILVEYSTATQLNLFGNYPEKSDVAPSALFIALFSIIAILHLTVFSINYYRGHYFWLSLGWVFYAICRVLGFALRIVWSRDLTDCKVGITSEVFLIVPTVLIASFNLVLAQRIFTWRHPVGGSRRIFWTLMWILYALVAGVVAMTIVTSAGLNIYLLSEANYARYKKVIMCTSVLIIVYSLTAVGLILLAWLFKPTKKDENLYTYQPWWIESFSPFYFVKKGEPQAAAISFLKRNHNHRYAIRVIAATHHLHKTVKGLTNQRGDLTHNVSLMIIGVTTLIILVSSILRTIICFQGRMMYFTSPVGSPAVMYVYWGALEFGVNLLYIIGRVDLRFYRPDRLP

SEQ ID NO: 22405 - protein, 65 aa, Candida albicans
LTLEIGFQVPFFRTNSGNFSFKLRAPIPDHRSSTVKIPPVFLAPDNATAEKPKSQETDFTVTHTN

SEQ ID NO: 22406 - protein, 77 aa, Candida albicans
  UNSURE (8),(57): Identity of amino acid sequences at the above locations are unknown.
IGFEIFLXKFAVAVVLMKMQKKKLMTIFFFSKLCWVKKKEKIKISIDFQTRVRVAIXKGITNKILNNQNLKNEIRIE

SEQ ID NO: 22407 - protein, 68 aa, Candida albicans
LIIICWREIIPFVSLFALLVFHYPTASFKSYLFILNLSYLSYLFIYLNKPINTHINTFNYGSFDNCSR

SEQ ID NO: 22408 - protein, 188 aa, Candida albicans
SFQLIINNNHRTIVNTYKSHICYHPSMTERIPLFEEDKDYIDEDHISEFAKALIWQDDYDYDANTTATTDITDTTPINDEVPGIVSSLPSTNGNNKNKNKDINGTVSDSSLITDEDIMNSSYFDKPHLSTNLKSNSTKNDDDDDDDDDLISRPQSGTTDNTSTTSLSSKRPDLITSKSDCSPMGQTEV

SEQ ID NO: 22409 - protein, 80 aa, Candida albicans
SVTVLFLFVFINCVVLTLVDSLLLLHKSPNNEPQWSRDQDKNVKTKKRRSPSIAVACPSPPPKTKYYIEQDNNYNHFNSL

SEQ ID NO: 22410 - protein, 62 aa, Candida albicans
RQTKHIYIYIYTKKQLESVFIGNLQYKSSFSIFFLKKKQFKKSDNILYISSLIQTYACQKKL

SEQ ID NO: 22411 - protein, 66 aa, Candida albicans
MTSQNLGFPVDDKLLFNYHSCISDLSQFYCCFIFFQIEIVILTKLIKGEDNRFINQDFSGSSIVII

SEQ ID NO: 22412 - protein, 78 aa, Candida albicans
KKELCYYKLKRIHTYITQLILNFNNYSILSHILSFHILMFFNRTIYSIVLCLRTITILRITIVIIVYLFSNFNLFFLT

SEQ ID NO: 22413 - protein, 88 aa, Candida albicans
STMKPDITGAITGPNNGTKEYPANAAFRDWASNISEMTPAHTFMGTQPNKPPMNRQTIICAVVCENAHPRLKNNDIQHDTSRTNLRPI

SEQ ID NO: 22414 - protein, 97 aa, Candida albicans
SCSDKGAIINGPNAHAKICIETTIDFIMGDDIWKSSAINVIAGDNIDDDIGATKAYNDTKPSKNIFLFIGQFLGSSVSSGPFHVINSGSMVSNSLPC

SEQ ID NO: 22415 - protein, 94 aa, Candida albicans
LLSLVRYYWLDRIIFFSSSSSSSSSHYTEATPPEKQQLLKIQKSHNNNNNNNNNRRMIINVGKYIYTPISSLTPPATLYFISRKFYFKPNQIIR

SEQ ID NO: 22416 - protein, 62 aa, Candida albicans
QQQPQLIRRYLEIKMTQEFFWSINNNNNFWFLLMYAKVNLKTLFYFFLGGIKKIITPLKDLT

SEQ ID NO: 22417 - protein, 117 aa, Candida albicans
IYSRTIFLHLCVHHCYLINKTSQHPQKTKLLKISNKSKYALIPNYQRKSFKRLKKSSLSLTYTHSYIQLLHILTSLQAICFYPSFNRLLLNKSSLHLYLLPKPKTHFSYKSYMTTTP

SEQ ID NO: 22418 - protein, 68 aa, Candida albicans
NSTDCLIPETELDLIFCSKALSLYQLPTLFLFQKITLTYQLDLIFRFMFRLVWSLHSAKVIVDIFMNG

SEQ ID NO: 22419 - protein, 83 aa, Candida albicans
PKNSTIVTIISSCTVVAHITQTQNDREVIFLILNINNNILAVYSRILENIPFSYTLQKNLARINQSVYLIYVNVYVSNTKRVI

SEQ ID NO: 22420 - protein, 159 aa, Candida albicans
RERKRKMSDLNNNEDRFSFEESPIRTYPSSPTPHPTEDINRILSSEFQKRNTITGNFDTDPNSPQADTQSNHTSPISQQLINHMDMDRESIYSFDSVSTSGRLLDRLGLEDDDDDDHEDHVDHYETDSDTYTLTDKRESMTSIQTTGRLSDRLELDTRS

SEQ ID NO: 22421 - protein, 211 aa, Candida albicans
IPKLPITKKKNYTTTTITTTTTISICTETTTGIQSLPPLLHLQRNNETPNLMQSVQRPIQKSQSGPIQNPQQAPAHLKHVPMNFVFRNTNNSTETIKSDMASLKKFETRKSVVPEIRSIDSNDEVPPPPPLPSITSTNTISKNSFTPSPARSTESLGRSSLDQSPILSPILQPSPTGNSLESNGGHQGFVELNDENSVIGLSSMKPIQKSN

SEQ ID NO: 22422 - protein, 86 aa, Candida albicans
SKDDLPSDSVERAGDGVNEFFDIVFVEVIEGSGGGGGTSSFESIDLISGTTDLRVSNFFNDAISDLIVSVELLVFLNTKFIGTCFK

SEQ ID NO: 22423 - protein, 68 aa, Candida albicans
IRHFSLSLTLMNNLDLPISLMFQLNLRKEKGKEEMVQLPDRKHVKKTEQTSKQYRQLFQIKISQNVFK

SEQ ID NO: 22424 - protein, 81 aa, Candida albicans
KFILSRIYVKFHFISDNYPISFSLFGWLLFFFLLKMLNTRKPRNGRVSKPMHRIRKLFYVILHFIETTSSPTELPESALRL

SEQ ID NO: 22425 - protein, 79 aa, Candida albicans
LLKIAFSHQIHTGPQRKKYIPLSQLTLLNTYNVNFLVIINKATVEEKEGRREGGKERKEREGEIQNSKLLVVVVVVLTL

SEQ ID NO: 22426 - protein, 82 aa, Candida albicans
FNNGWQNSRSSYNFPIKELVEENYDCYELINEEYDDRDWGSLRFVHVKVHSGMEGNEEADRLANLAVDEYGQRSIFRSIFGF

SEQ ID NO: 22427 - protein, 75 aa, Candida albicans
NSEVWIIIDCTKHNLQEKKKEQKEGRNERNDYNRSLDTHPHIIIATVELLLLQSIFQGQSILKNKDLINNNMYKT

SEQ ID NO: 22428 - protein, 77 aa, Candida albicans
YLKNSHGNSKSRTKERKKEFHNFTCEILVKEVQKVEVIFSHGLRKISFLDLSAISIPLMVLNSRCMIHTIICYHQEP

SEQ ID NO: 22429 - protein, 99 aa, Candida albicans
IINLNLLSNYFGTTNNQQQWLEDNEAGFTHFVLVGRDPFNNCSPPPTFLSPMVCRIILNYTLFSSNGKINCLITLLMLTKIFQLSNPIDIFLILSIVYI

SEQ ID NO: 22430 - protein, 93 aa, Candida albicans
ARGGILHKQLLDPPYSHNTSLLIMKFTNFLASTLMVSAAYSAVVPTKSEEIHVDKRTQYTLQGLVSELLTHAVVDTASLFGHALQGGILTQKE

SEQ ID NO: 22431 - protein, 429 aa, Candida albicans
RFKRNASATAPPNVTSTKPISKELDSHVANDNGSDSDDIDIKAADAAFVPAKISTATSAPISTNVNSNVANDNGSDGIDIDIKAADAAFVPAKISTAASASIVNNNAANESDSDDIDIDIKTASAAFVPVKTGTASSASIVNSNVANESDSDGVDIDIDIKAAGQAFVPVKTGTTEALAPIVNRKVTNDSDSDDMDIDIKTAGAAFVPTRSGTTETSAPIAIIVDSSEEETGNNKTGNNTISISREQLKTFAKIINKSKMGSGSFSNNSSNGQDVVDNKISPDTAPSAFAGMVEISDDGNGISGNNTPNRLNYDDNESYIPKSFASNFRAHERKTQALGSLQIVHQDPVVDKTPTKNYELASDNMLLYIYVGDSGGEDINAVCRGIDDRSRGYNKSSDPLFTFWVKLIPSSSFSLSVGGWFKPLMANTS

SEQ ID NO: 22432 - protein, 96 aa, Candida albicans
IVLISQLYTLVPLKLYQSNLPFIMKYLSIFLLATFALAGDAPISTDSKGSPSLIAKFEKTSKSNIEGTIKFTPANNGTVSVSVDCLPPRRLEGPRS

SEQ ID NO: 22433 - protein, 84 aa, Candida albicans
KYPMINYNGTATFCYYANIESTNTRVQLISCQKQTRRSRIETSLITKLKNLGGRIGCEKYKRKGTFCQIFLNCPYISTLHSCST

SEQ ID NO: 22434 - protein, 343 aa, Candida albicans
TTDPAHNNQTVIVNPKTNKLWINSILDLITQGTSSTSINYADYSTGARILGFLTSSSTSSSSSSHHSTPSILQKMIYGWWIYKSNFYQDEYNANHVLLDDDIVWKGGDQIGIRLSTNIIPTDIILECRDNNNNLPSTQTQGILLSIGFKPSTKNGFDKLSKIPLGLLNSHGQLSMTSSSSSSLQLPNQNENKYISKFKLIKQYHIKSSNGGGVDGIYHIRLPIRFINLQISGKDLYFKFDKIIKDNNDNINTIDNINININNIKVYGINEINAIKYQDKFQLLIDKFIDIEENDHNEQISTTTTTSKVIEINNNEKSSLMDFMTSRNSEKYQQQYDMNDDIYL

SEQ ID NO: 22435 - protein, 66 aa, Candida albicans
CENKQTNKQTTKKKSFSEQEARSKKQEARARELSEWLNKNITHQPNPTQPTTKLKKKKEMLIKWIE

SEQ ID NO: 22436 - protein, 409 aa, Candida albicans
IMTVTFTRQRSSSVTSISSNRSLTPSNNNINSGTFTHSSAPTPTPTPTSQPLHLPPLSMSNGSDQNPQHVLPSQITPPLLMIPTSGPTISEPTTRTTTTTATATTTTNTNTNADTNTNTSTATLPSTNVAPQLPSLLSTSTSTSNTSTTPVLPATNPTPTSVRSMSIVSLDRSPRNSIVSTDDNLRSHTRNNSTTSLASLTSHPVAVHGLSSVNLAHPLNPLHVHHKQMSNGSAIISDDDSELDQTTPSRTILKPIRRLKRRSNSNDPINRDFKLKFDDRSVHHINQQQQRQPTSPTLMTINPQSVNASPTSVSLSRFQDLAPITISNSSNNTNPPLDSKNLTKLKSTNLIQQSMYIKRKLAISKDLQIEYFNSVSHDNNNSIHSVATNTRSSSPPLPPPLSPPSIFSE

SEQ ID NO: 22437 - protein, 72 aa, Candida albicans
  UNSURE (63),(68): Identity of amino acid sequences at the above locations are unknown.
LDSKFFPPLPLALMSRKSTASPPIPMSLIPPNQPILQTLQEQNELIIKLNRRWNQASVNESKXATTGXEIRT

SEQ ID NO: 22438 - protein, 90 aa, Candida albicans
FGGINDMGIGGDAVDFRDINASGKGGKNLESNYSLKIEGGDNGGGSGGDDERVFVATECMLLLLSWETLLKYSICKSFEIANFRLIYIDC

SEQ ID NO: 22439 - protein, 67 aa, Candida albicans
LDIKYERYYLSIDGIPYFNNFFFMFRPISLFWLKTLLNINDLQGNLVSLKTAITLNNLLLQSKLNLS

SEQ ID NO: 22440 - protein, 60 aa, Candida albicans
IHACPASRQVKTKMTKEKKIGIRKKKELYKYYTSCKYYQTKPLKRSDICCSSIFQASKSN

SEQ ID NO: 22441 - protein, 61 aa, Candida albicans
WWISCYEMVIKKAPLLNNRFSMNFRQTWDTNHLRTVLLRPPTLAKEVIRKLIICICTNFRV

SEQ ID NO: 22442 - protein, 475 aa, Candida albicans
RHSLGSPGSYDSANPPRTTTLHLQQRLQHQFQQAQIKAEREAERSTRHQQSEQQWPVSNDDSHKSLSQLTASEGGSTANAFTSAGSGADFALKRSRRTDYRKKETDSKQKTSNNSPPTRKYNVRNSQLLFNYKKPVDSPSLSPSPSPSTSQSMMGHRVKHKKSQKPLEAALANPMMDGSDMSHNPYPTASTTIDFSRMGAKKSARQSLSPENAMDGRSRTKPENKTHRGYLHQERSHPYHQQPQPPVQPQTRQQLPPAQQAHRQSTRQTHNHPSTGVEKHHRQDNKRVMLSASNTDINDFMVQLNQFQTNGTRNHRYDNLHKKDKTAFLPNEDHQRKSHSTRNSNVRNLSSSSQQHLHQPYLTTSVAPKSRQLHQNLDKLRSEINEFKESLNKSELPGEESKREHRLRHDQHHQQRQRPAPSQHQLEPRNYNHNDRHQRQQHEHVQPQQVQPLQSDTSFDISHQDLSVKSSPPER

SEQ ID NO: 22443 - protein, 70 aa, Candida albicans
FIFFFSSNFSLFKVQCQTTKGKKIFVRLLDCLSNVTRLDCVHSHTGGKSEKLESVILKYLKQTNICDMKY

SEQ ID NO: 22444 - protein, 69 aa, Candida albicans
HRLYTIHTSHTNHSTMSDLHLQILKLVDDNSGVIENTLKSPELSKIDVSTLKANLTSLWAKRYDCFLQN

SEQ ID NO: 22445 - protein, 66 aa, Candida albicans
LIYFFMHTYKYIIAVFRVIASLHSRNVLVVVSFLASNKDYFLIRCNLLTNTKKFFFRLGIFYFSIS

SEQ ID NO: 22446 - protein, 61 aa, Candida albicans
IVSVVKMLLKKIENNLSTILKTFTTRVQSRKRDGRHVCLFQTFVITIFLFSLFAILLLKLL

SEQ ID NO: 22447 - protein, 66 aa, Candida albicans
PPNENNPTSKGVDRKYLLAKSGELNAKKIVKLEKYPVLIPIVCAVEAYDKLSGDKQVNAHPSTAIS

SEQ ID NO: 22448 - protein, 89 aa, Candida albicans
VKRGLVKWGAGEQQPPYKPERGNQIQEVDPLTNSKRTTQNNKRLGKNHRYKYLNKYFTNQRFPFTYYTFCFSWDHLDFPYVRKPTILCF

SEQ ID NO: 22449 - protein, 247 aa, Candida albicans
LLINSHKRLNNMPLNTPYPVEKNTFNISDEDDDFPTRNLNESSPLTQSTKRYMKQDFANSVTSLPSLPPKPSHLQPQNRPQHQQQQQQQQYPYGNLSAKQLNKHKQMFENSVPETNKKDYLGNTTTVRELPPIPDNEKLHSKNPFSDSRYASRDYDDVDLPPSPPHSDPFRNDEISDDDSHSDLKHKMKRNEKNRIRSLRRKPRFHYTKLPYFTMVISLIQIIVFIVELAKMAHLTGSAFQTIPYVN

SEQ ID NO: 22450 - protein, 168 aa, Candida albicans
ITYIYIYIFMSFIYPQPMSYYNHSNSSSDNITNNNTTTTTMSIDIPNCLTPTINLEDQLKLMKQQLSSNSNSNSTSTTSLTKTNTNTNTTNSHVSSPSETLQPLSPPLSPYQRNATLFSIKQPLPQLPACNPNSKSYLKTGNHEFNLENFNDYKLTIDIKPIAKNYYH

SEQ ID NO: 22451 - protein, 72 aa, Candida albicans
NWGSCFSDSLCHYCNSRACNYENYQFLIEVQMGKKKQKGVYLHGMKMFIDIEDVCVSQKTNKLNSTNGYLSK

SEQ ID NO: 22452 - protein, 87 aa, Candida albicans
PYVFLEKGSFKYGVKNCESKEKYSPQIDSRATFMELVMMIYYTKRNTTHHLFKTEILLIQLTISFFYIDFIVIMCNSISREQCAKKK

SEQ ID NO: 22453 - protein, 124 aa, Candida albicans
VSGHIRGEEVRFSTALFFTALGIILNFKLDTSGSPDDNSGNNKKKYFNHTAFNSAISYILLVLALFVLCVTGVNYFVTINRYAKHKIATYSFNNLTTIIGMTSIIVTLMAINITMIVEGYIEQS

SEQ ID NO: 22454 - protein, 60 aa, Candida albicans
GVSPRGTRRFSKRRRKKINTNKLLQFRQVFQPNVEGPQDCNWWAPKMVSVKTHCICRPQC

SEQ ID NO: 22455 - protein, 70 aa, Candida albicans
LGKTWDLVVEEELNICGGFIHRRGVDNHPGENKTYLGEVFPKPTYGDEESVWEVQLYNVKLNGPDKNYQE

SEQ ID NO: 22456 - protein, 117 aa, Candida albicans
IQFRNGYHHNEYEGEEYDDYEGQKRMDYGRSRSVSHEPPTNHSNVNGTSPMVGPTNGNKFERSLKSPTLSYINNSEELPVKTNFSIVKNKVEIDDILDKRTDSASDEEEEVIGKMED

SEQ ID NO: 22457 - protein, 93 aa, Candida albicans
FDFFKKNGGLRQMGGGSIITLVMVIEKYDFSLVQINLKTHTTNTVQEKKNIQQKINEMKKSKIKNHLIQFQTPFSHSIKQQQQHQHQLAYSFF

SEQ ID NO: 22458 - protein, 70 aa, Candida albicans
LRNCGSFQRPCVKTNRLMQQTVLFFSEQNLTPIDNEYECRSSRDRLTNRLEDRRNSFCGGSTLVDADVVK

SEQ ID NO: 22459 - protein, 60 aa, Candida albicans
METILEIKMMFLCLLWDLLSFGPMAYGNALTKTLDKSEITRTQNQSRKKKLYFFKVKKKI

SEQ ID NO: 22460 - protein, 87 aa, Candida albicans
LNNLDTTSIQYKTILRFNASEIVASPELLWSAIPDSNIRGLVLDKVIVHALKNVYYVSIGLGVVCAITSLWTTNKKVPKDEDVRKSK

SEQ ID NO: 22461 - protein, 86 aa, Candida albicans
QKNTAATPIASPSLRTMEDINASATTTTTTNIGGYGGLGDKKITHLSLNTQVPSQPSSAMSSSVKSATIRPPLSPLLVSTQQPQPR

SEQ ID NO: 22462 - protein, 73 aa, Candida albicans
SAGISRPDVRLRGRSSIGTPRRQSMVAPVSTSNSSRDLLESIQVLDLSKRSSRKQFPIFITKTSFISSTTTIR

SEQ ID NO: 22463 - protein, 60 aa, Candida albicans
FELKSKFHKQKPKKFEQQKDNKKTTNATFLTIDHDNDNDNDNDKFMKYVPKCRIIFNYSL

SEQ ID NO: 22464 - protein, 239 aa, Candida albicans
QYVHDLRKFFFFRTIFFLSFLFLTTNQPINQFYYLIYSFIHVFYIGALNSTMSNILLIVGKQVTKNTEQLFYTRIRHINCNNNIKDHLSRLSSLQIKSCHYFSTDNSRIQQVYSPTCFDWISRTDQDENVHSWQNNYFSSRFSRNNIPIKNKYASLPFQQQQFIEEMVELIKLGKSILDKVLGNLLSPELIAVIIDKSFENCPLMPSTSTGLEIPYFKTANKIHYDIPSSTTGLEESAI

SEQ ID NO: 22465 - protein, 134 aa, Candida albicans
DHRGTVGSLGEDLGPPFLQSNLEEARFDDEITVVTECNWNLNVIDARQMLKKIKGLSLYVDGFHKTLKNISLHSSRLHILDVHDDPFFDEQEYNASLEVVSSCSSEDLYCGSDSDLDEEENERAKKRRKKGNPQ

SEQ ID NO: 22466 - protein, 66 aa, Candida albicans
GNLFMRALSTVLNPQHLISIIEMIKNIEQNVFTLDELVDFTNKFGGETKLFHENEMPLKINMFNNH

SEQ ID NO: 22467 - protein, 166 aa, Candida albicans
WSDLPAAGEESGIAQTVALISAPIWGYLVDARRIGKCNTLGLAAIVGMIGNFGLSLIHSYSSNTYNPKTFICFFMISIIGLSQIGLIISSMSVLSGIPNAHDIMGSLSGLYSFCGGIGIMIISSLGGYLSDHWILGPFFILGLFNVALLVIYYSYSRQQKSGNLVV

SEQ ID NO: 22468 - protein, 312 aa, Candida albicans
GFKLVDLLSMVFWVEFFLYLKRRTRNHLTNQQPDVNKFIAGRDGGDLDDDDDESPLEEEDNKHIYHDNAGDNMVQNSKMGWFKSIFSNSGSGTSNASNSKLLGGAVGGGVAGASGGAGAGGIFRRLDRNGDDLERQAGGGYGSTGRNNNDTDNDFVYRGVTNSNNLDQIFRSNNNTSSAARNSTIADGSAGVTSGTNSAKHTRMSSYGHPLANPDDFNFNEESYPIAGGVIGGGEDYRPHTAFSSHYDDDQSSSGSTSDDGEFHPSDYDSFIMPGDEAPEEPAHQYRPRNIFSDGRQNSTNSLSRFHEDDIF

SEQ ID NO: 22469 - protein, 80 aa, Candida albicans
SLALGLIQQLKSLILFLKKTIETKSPTLNLHGILNTGVINNKQSGITEFPSLLLCGNYNLQLITQSSFFFCSSESNLNFK

SEQ ID NO: 22470 - protein, 70 aa, Candida albicans
PVLNETFKSTTGVNGRVSTKVLESRSPRPADLIDRCFKFGGKINNDLRKYCEFCKSFPIYSKLSNSSKEF

SEQ ID NO: 22471 - protein, 121 aa, Candida albicans
STKIHDQQKKYRKVKRHQPTTTTRKIQFQLGPLYLTYTFVHLKQLITYIYIYYPIMFRDRTNLFLSYRRTIPRDSFPTRRTRFSDLNNEEENEGLILSSTIGNQSNTTSKNYFKAAVEVYF

SEQ ID NO: 22472 - protein, 85 aa, Candida albicans
  UNSURE (7),(9),(27): Identity of amino acid sequences at the above locations are unknown.
LVEVQFXPXFPYVPAHRDYSSIAFGSXKKKSNQSIDQSINQSINQSVCLIDRQKYTTNKKNIEKLKDTNQQQQQEKFNFNLGHSI

SEQ ID NO: 22473 - protein, 69 aa, Candida albicans
SIMSYDPIHDTYTASTSSQQQQQQQHQQSSPPPSKSTHLHVTGSSPPSINQLISPNIEPSRSDVNQHQN

SEQ ID NO: 22474 - protein, 228 aa, Candida albicans
SRNTRMPPGRVVEYTEFPHKTVNLIHPHECFPQEPLSNEFKRLTQDSLERAGVNVYLNTRIRAESIEKRHGDLTTTNNKTIHSNLNIWSCSKHNNIGFLSQHIYENYVTSNKNISINQYLQLYNAEANTTIENFFVLGDLVELPIIKSAGWAMYMGRQVANNLSNLIFNGIFVEPFPDLNAIPYGMVIVGGNNEIISELAGEVEVDNEHYKQEYEDYCIGKIRATIDM

SEQ ID NO: 22475 - protein, 67 aa, Candida albicans
GRQKKSCSQKKKRRNIRLLEEEEIEALMNTKGGNIEIDPYITERGEKTGEVVILMMTFRHHIQKQDT

SEQ ID NO: 22476 - protein, 78 aa, Candida albicans
NEILYLQVWIQIGVHLYLMRRRFTKEESVFEKKKRGEVTTNLVKVKEEVVGLVLSDDERGGSNGGGGALLLSLLTFDF

SEQ ID NO: 22477 - protein, 89 aa, Candida albicans
ISCIYFINKLQKFVHIYIYIKCNQLYLIYKVIITLKTSSVYILQNNYCFDKTTILDFSLPPTNNLYNLYFPVLSLVFNELYRLQQKQSI

SEQ ID NO: 22478 - protein, 83 aa, Candida albicans
LELKSRRLVSLDLLKCQNIFRLVATDGLENATGFFSPIFCKFLSNRVESTSIRNCHDKAIINRTNISIYHLNTCPHLCCMYET

SEQ ID NO: 22479 - protein, 96 aa, Candida albicans
PSITLYYYTKKKNKRHVIRDEHNTPSLFLLFITRNSNNNNIIDYKKNDMASFGVVVLLIIVCIINTRPKPGLLKIDNFVPSGSYTYKTIYKRNYNF

SEQ ID NO: 22480 - protein, 93 aa, Candida albicans
PISSNSAHKKKFSMVHENTLSRDALFFTYEEMISLLEAGGNYCICLIPLLRYRRPSHGQGHKNDIKNCNYVYKLFYRCKSPMERNCLFLEVQA

SEQ ID NO: 22481 - protein, 203 aa, Candida albicans
IERKKYEETTMSAQTTYPKRNLEVIPFSYQLEFIDKVVSSPTKSQHQSSNRYHNNNNNNHHHHHQNQHLHLHQQYQQYLQQQQQQNKYTLAAVAAAAALQQQQQQTFLLQQQQAQQAALAQKKQQQQQQQQKQTQHQHSQLFVNYNSQSPQVFDLHTPPQVFGDVPMDKSITNSSMFSSVSQPLNTTGNIDLKTNFDLGYIIV

SEQ ID NO: 22482 - protein, 100 aa, Candida albicans
SSENLKRKRKRNNAGCKKTKKKKFLIVCVCESSESSVIVFKYTLFNWTCGKGKRDREKSIFFYSSKVHILQCRHMTNKIADPLHYYLFICRSYNPRQPID

SEQ ID NO: 22483 - protein, 63 aa, Candida albicans
DHHDAQEHFVDKLYQFAPKNRYHPLEKEGPLVGEVDEGVDKLEKLFYDIKDKKLGMDDVLLPS

SEQ ID NO: 22484 - protein, 213 aa, Candida albicans
SNSSITILILHYPPKMTEPTLNFHIQTHQNQFKIPHELIKKNFKLIQKLIEKQRKQLIDDISKIKKCKTTSPSFKLELIQKLIKNFESFMKKLQNFINKDEEFRSRLIARLENLTELQQYVITNNDNQEGQNHEESTENNNNNRNNNNNSTTTDDDKLLDFHNPNLINWYRDQTNLLIVDYLIKSNTRTRFEDNGEDNPGNIGLLLLKNLTKT

SEQ ID NO: 22485 - protein, 73 aa, Candida albicans
QITVKQRKQFFIDGWRKYLSTSKYKYLNISLRTGLVENVPIYIFRNIDSKLTVLSVLHREQLDTAKIVRGRDK

SEQ ID NO: 22486 - protein, 81 aa, Candida albicans
RNVQVFILAGGQILPPSIYEELFSLFYSYLSRARTFVIAIIVGLHFQTIEESIAMGIGNTKYTNWAIYFRIFLFYPQKAKQ

SEQ ID NO: 22487 - protein, 250 aa, Candida albicans
ISSLLIQYNQIKSTYQENMLFTQLITLLTVTSQALSVTISDLNNIASNQVTKRLGGGSRGGSSSGSRGGSSSGSSSGSSSGSSSGSSSGSSSGSSSGSSSGSSSGSRGGSSSGSSSSGSRGGGSGSSSSSGSRNWGSNQYHCSGNSCGYGNYYAPSAAAAAVGYGTGRYTGGTQYGNNQYHCSGSTCGYGNYFAPSAAAAAAGYGSARYYAQHHNSTSSESETISGSSSLNIPSTHFYLIGFAAAYSIVL

SEQ ID NO: 22488 - protein, 179 aa, Candida albicans
SCRKTEEKKKRKKSRRQKKFILLMHGTMITIDFFLKLVTLPYTVTKTVLQYYTVGTPYSRTNQEFRNSLWKNVLLSVQYHVSGNYKKENIKAVIYQPIDKVIAKFKTHPLASGLAHFGEKFDEYSYWIHKADTQGKVLIYIHGGGYLLNMFESQFVFVSALHYALDDHAAENTSILVVD

SEQ ID NO: 22489 - protein, 109 aa, Candida albicans
IGNGQESKPMLNLVFFAIQKNTLLWNVHTQGGCNTCGKKGHKAAHCYLKKRKLQKEQFFPTLQMKRKPLENRNIEVNNRREQEINLEKPTQGNTKKYCCFITSSILDVI

SEQ ID NO: 22490 - protein, 65 aa, Candida albicans
KERENILFLGFSLRLYNFSRNVCGDKPYLTNTIGGEVIFANKSKRGTNLDSVMYKLSLLSTTISR

SEQ ID NO: 22491 - protein, 63 aa, Candida albicans
  UNSURE (8): Identity of amino acid sequences at the above locations are unknown.
LLFPLTVXKIPLPQVSIKELTDGVLLSIDDEEDDDSDDIDIEFINGLVTILVIPEVNSITFSF

SEQ ID NO: 22492 - protein, 96 aa, Candida albicans
LHVISLTPQKSLFIFSKASFSLLHRLKGETSTNFIVVFVIAQIVSLYEGQKQTRAESTAELKMFFSSIIYGLFSCHYVEFCSTRDVSTFFFILTIN

SEQ ID NO: 22493 - protein, 60 aa, Candida albicans
  UNSURE (36),(39): Identity of amino acid sequences at the above locations are unknown.
CCQNAILFTYTRINYYPKGQHSAAKSKFSLQLKTCXYNXYSKFNYKACSSSTVDKSRMDG

SEQ ID NO: 22494 - protein, 61 aa, Candida albicans
YISCQFNNSNNNNNNNNYKHSLIFLFLGQFKSSQLVITLLYHKTDRQTKKILNKKKKKEIP

SEQ ID NO: 22495 - protein, 70 aa, Candida albicans
DCLFESVKFIKSIFGILRLSTTTYELFYLPYLTFFRNVIVKRNFLFLGTICSCSNTTNKEKPASINKELI

SEQ ID NO: 22496 - protein, 110 aa, Candida albicans
SSISFHLIIKSTNKLGKHRITPTQNSITVKRNRFTLLTDKELYAAIYFSQNKIRLELKKERMKERKDEKNIKIFFFCFPISLCHSFTHTHTHTLSFFLSFFVGLSICQVN

SEQ ID NO: 22497 - protein, 66 aa, Candida albicans
LFFLFLYTLSFSFFNMTVSNSQTVNYINPELTDAENAKPGRHVNFPFWIWPHSTAILKTKRSFSLI

SEQ ID NO: 22498 - protein, 571 aa, Candida albicans
KNGKHSVKGRDTPKGNGGVLNMILLVAKMRMEMKMKMKTSWNRDINTIIIRDRLKLYNHFLRYPEVVINNNDDRAELASTKNNLLVRLPKLNNRRLIGSSRKKTLKSKSKSKSSKLKHKSRKSHKRRPKLLKSKDVETNEITTVEVITLTITKVLARHDLAAIVTPIQQHQSGHLIIGYPLPIATKSRLHGYYKSSGVLKEVDANPTEEYDSGDGKENTQQNPIPEKMRLPTNDDPYSLKPTHHYDPSATMQNPHKQFTNRTGNFEIPTNVQDIDDITFPIDLSSLDSTLNLYSILPMNQTNLPDVNTLSLAPGTGSVPPRYSNHHSEFTVERPPRPSRTKKRPRIKAKKTMKVSTQISSAMSKSIHITRIGSTSSGIASGITNIVIPNSSSSIYDNYQDSSSDKQPVSLSMPTKTITMTTDTTSEPVTITEKLDKPKFPDIFTIIRSKLLSKKPQETKLHSPTSTDTKSSKLMSSSSSNNNKPEISKTTKEYNQTQESTLYNTTKAVPKTSVVSSTTSTKPNDQGNNILNSFIQFTETIHSRIRFPTADDNNNNAVLHHRGREGSALSGK

SEQ ID NO: 22499 - protein, 581 aa, Candida albicans
QQENPQFSTNNLLIHHHSSRVYINNKIKTIQQQKKLLKSPTFSSSFNIPISPLISNSNLANIPSPTPALTHTLTTPTRLHLRSNNKRALMQFKRHNHMNIKDSSLDLKKTTTTILRNFDRTDIVEQEGDTDFDEEKENEETEEVDFDQVHDIDNDKSPESQFSESESKRYSQVGFSTNGNIKLPTSKVTVIVPPTPVKKMEKPPLIEDDIQPSSMTPPKLYHPQFQPPPSSSNSIRTENEDLNRRGSIRKLMDNWKKSLIVHKVSSSATDMPINRTMSTKPSTEDLDRLINNAMSVMNEKTVIGKRVDVLSARIIDELEYLIRYYISSESSSVIHEMNYHDDTGDDMEMEVINDNDNDLEEEDDDDRPHRRTRQDKGDVDLHPIEVSPTRADEIEMDINDLSDLNIVKIDNLINDTTADNSHSVKVPKNISTSYFLDEIDIGNDNNNDNDNENVKESSSTSFQSPISINWNDEDNINLDGSIEKTPLEEEFEGFEFLQEITTTTNNNNNSTSNDKKQTQPDYSEPNFSFQHSQSQSYSQFQSHSHSHSKSHETSSISTPSNITQYDAEIEELGIAMSPQLI

SEQ ID NO: 22500 - protein, 65 aa, Candida albicans
CQLKVLWCGPMVLKEESYETWDVPYPEVAKLFLNDLKTLNSLMPVSMRSVSIGTDNYLISYLSYT

SEQ ID NO: 22501 - protein, 162 aa, Candida albicans
DGDLTINATGFDITTTSNDRVHKVNQQSSPMPKKIVIARERYPPKVLYDGEGNLRYFGESSPLSFLFQCRNVFVDKIGDSNFTLESNDSLEVIEDSDESYEIIQVALPSRQILDDIIKIFYMNIQQAVYFVNIDFFKSQIINPVYENYRALHLGNSPTRGLW

SEQ ID NO: 22502 - protein, 93 aa, Candida albicans
PIGSSGVVKNLDLISFVLLFITTNTNKPLKLKIHSSAVLSLVCSKFHNLVYFYCSFTYKILGKDQKQYDIRVQIKRKTKQKKQIKPIIISNPS

SEQ ID NO: 22503 - protein, 73 aa, Candida albicans
VPINLPRILFHRNAFYLELNYESSCWFGRNKFKQTNSRRYTKAYIFYALPFMETELLIVAFFDKFSDIIFSCI

SEQ ID NO: 22504 - protein, 543 aa, Candida albicans
HKNKNKNNDDDYDYDYADLFIPFSNSQLDDIVNISKYNKLTLSLSLPTILEPTSSLPNKSPRLISSNSNNKLWHISQPKIDYINIGSTLEILLLAKSNKILDTTTISFQIVINKYINNNDKVKTFIIIELIGEYLGKFLYYKFYKICQLYLYSWSIQCNHLINSSITFIILGPNLNIEKVLLKFIYYINQLLLNATTATNSSSGGSGCSGCYCGGKIDYKLMVELKNKIRFKYKNYSNNEDESSDVIGDDDCLRKIIDSSIMLLENDIWTIEQRIDALNLIEIDDLLSLMKVLIVGGGGGGDDDDDQRFINVLISTSMDEFNVINLNQIIMNQWEIPIIKTSSISNPQLNKSLSRILLPGQNELFKYKLTNTTTTTTTTTTTTTTTTTTTTTTTNNNNNNVVIYNYIQIFHQRKPPPPSPSTKNKLNYYYYYKMILFKFINYFIQQKFNYQFRIINQIGYMIYSGIRINKQTMGLYFYISSSSGSSDINTYQEILDELNRFLYQLELELELELTSNKSQSRSRSRSRSMKLLEYVESFLKFSP

SEQ ID NO: 22505 - protein, 61 aa, Candida albicans
NEIKEKKKKKQRPTIKRFNQWLRIKIAIQNEDLDSKKGLKFVNLLISWGMLYVVCSMCVWY

SEQ ID NO: 22506 - protein, 72 aa, Candida albicans
NQNKTILELFPKLDFKSAILQQYLFLLQLWVQFKLFACGERESGRAIIVSQPLLNYIISFPNILRSDLPNDI

SEQ ID NO: 22507 - protein, 62 aa, Candida albicans
CGYAIIVEWNLQNLCCDQEHNHNLEINLISEENYTNKSQNDLFVLSIFMKYCYSKVKNCQLQ

SEQ ID NO: 22508 - protein, 92 aa, Candida albicans
YLHLYICDLIDKHLIQIILYSYILYSIYYSAGYTERESIHMIKRQILLIMTVYDYILFLPYLRPHWNTTNYTQFQKKIKVSTKGFIIQFNLF

SEQ ID NO: 22509 - protein, 60 aa, Candida albicans
IASLQITWKNFLSTDLMICITCFKNDSLSKHFNKNLLPTTYKSERKLGVELELRIPAIQV

SEQ ID NO: 22510 - protein, 277 aa, Candida albicans
GAGSSSFCGEVWPASILNFVRENLINKVFNLFKLLKELEITMSLLCFKFDPTIENLQDQADLPVELKKLFDLSLRYQCYRLVNNAILKLYNNEYTDVSIATTNKDMLRSKSPFSDSYYLTNDETVQELLEDREESNKRKMTRTYHGPKFAEFDLSNYKHKSRQQQQGINYELSDFVTLEEQQRNNEQEELEAVDEEDEDDEEEIGYHINPDVNLYSNGDADKDMKDSSIDNIGTENEDEMNRIINLSLDSRLERVIKLWLLTEQRIKDLNIVVTNRN

SEQ ID NO: 22511 - protein, 94 aa, Candida albicans
DFEMNEEPEFGSIIIHLRGRVLTLINDSEYLRQFNQSSGKKSDNSSDNNKNELTVDNVKIYNNKNIEVGTHENDNYLSKCNIETGNTIDVVVVI

SEQ ID NO: 22512 - protein, 75 aa, Candida albicans
YLNDKSKSFFNSTGKSAWSCKFSMVGSNLKHNKLMVISNSFSSLNRLKTLLIKFSRTKFNIEAGHTSPQKLEEPA

SEQ ID NO: 22513 - protein, 75 aa, Candida albicans
SFVHVIEHMYTPYTHLLHTIVRQPTTTRVVKFLLRHTITSILKKFTKTINKLQQQPRPPLSTFSSTVFTTGLEGS

SEQ ID NO: 22514 - protein, 61 aa, Candida albicans
TFICHHRYQYESLLFLFPICLIKLEFLLFHARYHQINITLRLKYKLVQTTWQGRHSGHNYF

SEQ ID NO: 22515 - protein, 85 aa, Candida albicans
LQIYTLKLIHSTICFPCALYRIITSMARNIFLCLEVSGFVDIDSVFDDFTTKDLRNSNCTITQIIPCRENDYSIETQAFLLVSGY

SEQ ID NO: 22516 - protein, 66 aa, Candida albicans
LNLTLYHKSNQIINRQKNSWKFTWFNFDETSTTVISPSSPPLFHYTVTSSIQHRPEFLMLTTGGNP

SEQ ID NO: 22517 - protein, 71 aa, Candida albicans
  UNSURE (9),(39),(63): Identity of amino acid sequences at the above locations are unknown.
VMFSFSNSXVFGYWILLILDLDKSRHPVPNYDYDSPDDXVNHFCSQVVGLNTGVHKILDLDSXLHDEPFAH

SEQ ID NO: 22518 - protein, 75 aa, Candida albicans
  UNSURE (30): Identity of amino acid sequences at the above locations are unknown.
NRPNVPLDIILTFFGQNHRRELFDRPDIRXRADPTWQVMPDANIHQETTTVQTPDHGELDTMINNEHQVPRLWGG

SEQ ID NO: 22519 - protein, 138 aa, Candida albicans
ISRKVYQNEMRELAVCVKRLINFWCVESLVFVFYIYTLFFYLPDAFENGSCVIFFFTTKLKPLCFDFALWVLIVSPGVKVDGGSGVVYNRASSTSKQIEMANTFYIQRKKGVFKVRFKLERDSSSFFKISICGCKKVF

SEQ ID NO: 22520 - protein, 69 aa, Candida albicans
FTKKILRLFSIINTKLKIILTNLHHINKNSFLCNYMYGIEQFKQLLLSIIVFSSTIFINPHWSNGRKEV

SEQ ID NO: 22521 - protein, 65 aa, Candida albicans
NNTCGQIAVVVVVVEVIYPLQNLVQNFLASVQILPFFLILKNAYRFWNNRRSEEEKEKKEKKLVE

SEQ ID NO: 22522 - protein, 62 aa, Candida albicans
VYVYNMIQENILQKPKKKPKNNGLWIHMGRKKSRIIFNPNLKERERNREEEEFYKERKKQNI

SEQ ID NO: 22523 - protein, 63 aa, Candida albicans
HYRYLYIFKLHTQLSIYISDYSTSGYSTHPPTHPYIQLYLLFQFNFFLHIKLYLFHFISILLY

SEQ ID NO: 22524 - protein, 86 aa, Candida albicans
KENPFLNKYFWGNYWYIYISSVKLVSYIYLRCIHKKKKEIEIKKKKIFILVRKKVKLYLLHKTNFFNFHLQSKKKELRQFGFCVTI

SEQ ID NO: 22525 - protein, 68 aa, Candida albicans
KKKRNRNKKKKNFHFSEKESKTLFITQNQFFQFPPPVKKKRIKTVWVLCNYLTGRFFLSFCYLNSTNK

SEQ ID NO: 22526 - protein, 110 aa, Candida albicans
LFIMSGSFWKFSNGFTSLSNISTLLENYNRDLESGKVEEEGQLEVLKKLLDENDLLQELLSNNPMLMSFLREDKILGMLVNLVILEGAVDEDNPSIKDSKNIIDTQESTY

SEQ ID NO: 22527 - protein, 438 aa, Candida albicans
FLRVKGEVKMIDLSKKMKLMENHFKDKYRHFTSPSEDSRNSMPATLKKKIFFSGNLFMVSIYMHIFNYYESKQNVELSFFYLKKMFVTTIFETMPYFTEYVTNTNDVFNSGSDIIAIPGYESVAHKSLIVIAAIYLRLMYRIRMFKIRYDHNTRMNSDAIEDEEYKAHFNKLIKCSDLLIECREIFRCGLAKLSNRYYYAWRVTKAQNFIGSMITDKFFESYKPKCVHNGYSTEMNTELIYILESTLDKVREMNKLRKLHQKQMKNQSHSKQVLQKLHYHQLYQLQPQQQLQLQQQPQSQYRSQSHSWNGTGANPQYSYGDQNLLGERNPSLDQTSMASNTTSDVDINDYKTNDEIDSIWLQMMNLKNQDTIGTPGNTQFGGGGSGNWTTSFQADQSNMTFPQVSNKPAGGNVANVSLGTRSELTSGNYEMGSVHYTK

SEQ ID NO: 22528 - protein, 192 aa, Candida albicans
GAFTGFKDRDLKVVLRFLIDSKIKFNSLSLSGFSNLIAFHPTVTNFLLLYNTPIRYEIPGLKKLAIVLGCSGIRNRTHTFLSDLEDLTIKDYQVTQLNLPPFLRRLSIARFSDSVDIISEKLVSLEYLELEYLKNGFFIKTEIAAPNLKTLILKKCQSATNFDELRRFQKLKHLLLWVTSLSLICHYCTGLI

SEQ ID NO: 22529 - protein, 65 aa, Candida albicans
NFFLSFYLKFSFCLNNVAKKIQKSIQILPQLFITQFLKFNNRSFKAFIIVEYAMIYFYSIIYSLK

SEQ ID NO: 22530 - protein, 229 aa, Candida albicans
ATFIFIQYQHTDSMDELIQNIIEPSSLSEDTINSLHELGDLLRDGTNRIIIHDKLSILLPRFNQILSLLTNQNQNQNQNQNQNQNQNQNQNQNQNQNQLLMNKLQLETLRVIINILANNDLNRDFFTNLTPKLSEINNKKDSHKDKEKGGEFDIDIIVNEFWSIIKIHLDNYMNKIDHHSDRIIEFIFILLNQFIYDTDHKSQYLEFFNSLKIQWEIYPLINEDNIGDM

SEQ ID NO: 22531 - protein, 78 aa, Candida albicans
MLRSSQHIRPIWSRNFHQTTTFYGKQLLRKLRDDDIDPLTIRKHQQQQQQQQQRRNQRKIPSEEFETKSTTSYNLKGA

SEQ ID NO: 22532 - protein, 254 aa, Candida albicans
VILLYCQTSISIVVKKNFFLNQTSLKNFGEYSQITNRTRTRLAYLFNYTIGMLKYYNRALTCEELVLQLSSVKDTTCYILISDPTLYYSHHSNDTIKLSWKGIHNLNNCQLILIESWSEIKEFVSNIVDRCLIVFYGIFKTFIELGLNSNEGEKKNGFLQHHHQFCGWELNKLFHLLFLKQSMYGVDVIVNDGIEHDNDNVGGEPLIWGLQIPNVREKLRQDTTTTNQEEKMISLRVIFIKWFEMTNKIDYSTV

SEQ ID NO: 22533 - protein, 379 aa, Candida albicans
FVLSRNIYVYMTTTSTALLDTLSTEVTNLNQSGTDSLNDLLQDSNEFLAELRLIELDLIEEVNSQENELTPHKPVDPVDKLLKLSDKWYKSSISRLKSYNSANNKFSKNILNNPKFSIELDDAYTYPLLLNNYPRNNLDGHQQKHGSTRSKDINIEAPEEGHPLLPKSSQLEQIKNENREELIKAIVLHLLKTGQCDIVPEVLKELPANTSNVIDQDLFKKFEVLNQIVDNIIARHDLSLALQWFQEKYNERVAINAKNSILPPNTSADTFGSINLSWDQTDSFHDIEFKFHMLQFTILLNGENSSFTLDNALKAYLYSKDNFSKFFKDYIHEISPLMTLLLFRTDKDTDTFDDFSKKHMVTTVKIFINKNETGVLYGE

SEQ ID NO: 22534 - protein, 89 aa, Candida albicans
FIFITLVLDYNPPLILTYRELVFSTFFFYFTFLVYTKTPSYHPMTSVEPDIESEALLEIAANDAYQAIIEEEEEDVDEANSSQDEDVIW

SEQ ID NO: 22535 - protein, 76 aa, Candida albicans
IFNSSVDNCDSGTYDNNISKFVALGGLESVKNPAMLSFLDGDGCKHTFDLTYNNSTSFSSKVLLVGIWIANVGCFL

SEQ ID NO: 22536 - protein, 68 aa, Candida albicans
RNEKPKQHRKEAPKKRIIKRKKGRKDEQNKNASKTGKKDRKGKKERKEREKGRRNKTSPPFPFPSHFL

SEQ ID NO: 22537 - protein, 66 aa, Candida albicans
NGIMLVTTCLHFNKKLLKKIENNEKKKCTNLGTTSQSRGPHEQNSIQVPIMYSNNKKHQLTLCFGH

SEQ ID NO: 22538 - protein, 82 aa, Candida albicans
MKVVWQDEIELYLYCQIEILQQTLYFKDSFDNFISLETKTNKLKNKLKKEMPTGIPRSIDQPKNERKLKLKIETQIKKIKKV

SEQ ID NO: 22539 - protein, 76 aa, Candida albicans
WGFKRVYSFGPIFTPRKLYNNCLVPIIIITINLKKDNHRVLKKLLNPNINLYQFFKEWIRYLMIYNMLIIIKNSPY

SEQ ID NO: 22540 - protein, 91 aa, Candida albicans
FIKFPITITNISMTIITTDIDLFQEVAKLPYEVIALIVSYLPKCILPQLLYFQPIQREVASTILSDVNVTESIYRHKGSDILRPRRLEDPI

SEQ ID NO: 22541 - protein, 73 aa, Candida albicans
FIQVVNFFHLPDGIAERRLEYFVDKIERNFVISARYTLLQIFHTNSKKRGNPYQLDGINHFVSFDFKYNWILV

SEQ ID NO: 22542 - protein, 65 aa, Candida albicans
NNILKIIHTFLKCVNIRNIINSMCSELVAKLSTQFTLYKTYTFSTFLYFFILAFLLESVNTFFII

SEQ ID NO: 22543 - protein, 77 aa, Candida albicans
NPSSILLGWVYLSLLKNVSSVWIFYTFRLQVDKDMKGQMTTITSWHKVLGNTMQKNSNILHQLHDQKITEGIVKPRS

SEQ ID NO: 22544 - protein, 62 aa, Candida albicans
KLYYMVIKPKPTTIEIPIVAILVNKLTETMLAADLLPLEPDDELEEEEEEEEEDPDPESEVD

SEQ ID NO: 22545 - protein, 107 aa, Candida albicans
VHCLVFSFLAQFIITVLEKGGKLLLIWNGLYDSSDWGPFGAFVIAPVGGVIITLASAALRIAVLYAYSKVTGREFTALDKPVTVEVENQDHTYGSIDDDESDTKKVV

SEQ ID NO: 22546 - protein, 169 aa, Candida albicans
FDRWSFQPRGEDTGFLAVWSGDLIVGDENGYDAFFILLSKMPRWLVAFVLIFCIVLSTCTFDSLQSAMVSTISNDVFRNKLHINYVRIMLILIMVPIVVLAVKVADNILQIYLIADLVSAAIIPSVFLGLADTWFWYLRGFDVMAGGLGALLGVFIFGTVYYHSARERW

SEQ ID NO: 22547 - protein, 101 aa, Candida albicans
IFSNKYRRFFFLGQLDSLKFHQYHSLMSFPPLFIINCFTDTSAPLHLLHLFSQQHIKCSCINNNRNAAGIDSLFFFVINSFVQTLSNTIYYTKISYVKWRF

SEQ ID NO: 22548 - protein, 61 aa, Candida albicans
CSSKNPIPCKKNVKKMNTNKTNKEMTDFIVHKSMKKLKIAQAIKKNPMAFCNSFNVGSTVA

SEQ ID NO: 22549 - protein, 270 aa, Candida albicans
EISFMINHQCEKALTILFDKLTTPTTSISTGTGTGRRSIPLTIDKLISLYFEINKITDVVQIQSIHMWNNLMNETIANKILTILEDYLLKFTKIIIDNGKYYREILILYLKFIKKLIKLTKHKDSPPYKVLEYIFQNLDKDHNSNDILDIKYLLLQQGRRYTKEMFMELLKSLVHGVNTTNVLEQLKTIAIVNQQILNGELIVNNNDVVYELLVKNYFHPLENLLNQFISLLEDSKLQDNNNNNNNNPNWEIKIFQNNFKFYRTAVTDPC

SEQ ID NO: 22550 - protein, 97 aa, Candida albicans
MFLTPCIEKLSNFFKLYSNSSFSLSSYNKANFLIKKYFKKKIPLSANLIHSLISSFSKQTLFQMFKTIDKFAPLFKNPQKTLLKSKFPANQRLKRIK

SEQ ID NO: 22551 - protein, 75 aa, Candida albicans
LEIQVATEFSIKISLFFCLLFPMLFVVFPLYIVVREQNFDSPLATVPLNFTDSVSFSVGYLLLKRFRLQVRVYEI

SEQ ID NO: 22552 - protein, 101 aa, Candida albicans
EWRCVEMCWRLISDGRKHSIQCARLERVGPLGYVQHEVGLGDQKKKNNLKKGGGGVDWVLLLLISCVCVCLCVCVANFIKKFLSLSLFCKSVNKNNERTER

SEQ ID NO: 22553 - protein, 130 aa, Candida albicans
TGFQIMFGVGKSGTFKPKYGKNNPSSTSFLPLPATFHQINRKKRLPLILIVLFIIWYIFFNSFLSPFSYLFSKSISKIHYPQAHPLTSTQLIETSSKYIYPPIGTCPNYYYHLTPRRLFIDHYLLRRWNG

SEQ ID NO: 22554 - protein, 78 aa, Candida albicans
NYAVKLMKIYKIKQLDFLISINKFTSSDLPLEMRLPGNNNNKRSSSSTTTTNTSICNRWIVDNMVVSIETQHLVENLN

SEQ ID NO: 22555 - protein, 110 aa, Candida albicans
  UNSURE (10),(12): Identity of amino acid sequences at the above locations are unknown.
IGRMISGGNXDXSGGGILYEFGNNADDDDDEAVDADEDFVLRVSIEYTDSSSVDADDSVNDVGVDLYDITLGLDDLDLNEYVVDKEVNDIEFLFTRFTVAMSVKSEVTFS

SEQ ID NO: 22556 - protein, 76 aa, Candida albicans
  UNSURE (58): Identity of amino acid sequences at the above locations are unknown.
MGVGEPRIKYKATKKQKKKVEQSDCRRHVLPLKSETLGLDPWIYVSICGTSLHSGNDXIEKKKKQRKISNNEKKTV

SEQ ID NO: 22557 - protein, 63 aa, Candida albicans
LVIPTQLIKKITKLQIKKNYCKNQVSYGMDLKNLFLYTFFFCCRSEYVVDGEGVMGLCVVVFL

SEQ ID NO: 22558 - protein, 67 aa, Candida albicans
ISFPFKNDSNQIKCLDFSFSLFFLTLSFSVQLFKKAYLLLKRFQFQYTIFKSFGNNCPNHNNSFTTF

SEQ ID NO: 22559 - protein, 101 aa, Candida albicans
  UNSURE (37): Identity of amino acid sequences at the above locations are unknown.
ISVEGYDIRVLTYRDGKNGALVEFKPREGPKLLGGFXGVNNKAQEVVKMGKLVQRPINNKFKTFKRERGEGLKENYIPKPTRRLILSRLEQNPEQGSTDKQ

SEQ ID NO: 22560 - protein, 70 aa, Candida albicans
QFNNMKHSFDTPQRGNSIHHSFGNPNASNTTRSTINIVESPDNRGSIIATNETSSSPATTKNPQRLMFNS

SEQ ID NO: 22561 - protein, 86 aa, Candida albicans
APDSSNLLTPMLLYNFWDIIYTLNLTHLFTRQEVLTHLKHRVIEPTILIMVTIYMHLLRYICLKMNRLLVGKKTQVEIGKFGCYLI

SEQ ID NO: 22562 - protein, 63 aa, Candida albicans
VSYLNLELSASNLKKKSKRKCVYSFRSIQALLLLYFTTKLQIDLIFATSFDPKKKLYIRLIIY

SEQ ID NO: 22563 - protein, 62 aa, Candida albicans
RLLSLSLIVSNYMIEVINEMVLIGEGGGGGRRRFVEKVEKVEKKNLSAAVWPSPNFHLFPIG

SEQ ID NO: 22564 - protein, 101 aa, Candida albicans
FSQQLPANLNMSLLARVLQISSDKHLTKKSSSARTTITPVSSRTSQVSKSSSSPPQSVNQSPHSAYTLSINIESPPIILYGAPVDCGGRISHSGKLDSGGE

SEQ ID NO: 22565 - protein, 66 aa, Candida albicans
NYTTNTLFFLFFTNLTTQPTLLLYIQHNAYITHTHTQTNNTYIAYIYPLILFNFSFHFFKFWYFFF

SEQ ID NO: 22566 - protein, 80 aa, Candida albicans
KTKKKECLLYNSNQNVEKLKLKRIISYKNNNFKNKKKKKKLNKLNNKRLCSYASILYKIFLSLSPVTSLSLSVICINTEK

SEQ ID NO: 22567 - protein, 82 aa, Candida albicans
HKNEIHPIKTVETFIRQAYSMEYNTLHFFRNNNYINPCKSPLFCFKRLINFSLHYFSNLTIFTYNLNESCRPRSKESFLDLL

SEQ ID NO: 22568 - protein, 140 aa, Candida albicans
TFINCRNNNCKFSIVLKNLDLISFVLLFITTNTNKPLKLKIHSSAVLSVYCSKFHNLVYFYYSFTYKILGKDQKQYNIRVQIKRKTKQKKQIKPIIISNPFHIKSILIIIFEPPRIHLFVVKYASNQLTKNENINYNYIY

SEQ ID NO: 22569 - protein, 66 aa, Candida albicans
IIVHYYNIPISRLWIEAKLFIVIYTDFRHPPSGFIIYLIISFHSHIILGNELYHIFIIWSKREMRS

SEQ ID NO: 22570 - protein, 111 aa, Candida albicans
SVASTNRNTIMSLNVVIIGVELVLVLLTTKNLSFRYKGKGNRAITIIIIIVATTRKRRRNVIDSANAIREKSYGIVIVQVVNCELCCWIQFSFFFFNCILQIFLPLLLYYI

SEQ ID NO: 22571 - protein, 128 aa, Candida albicans
KMTSTNGQHSQQQQQQPGYNIATASSPASATAAAAAPTTNTSPTTAPGIVDSTSSHTTATSGATATVTSQTVIGSQPTSTTLTSDPSTAFHHHSQEFRRVCFRESIVGSSGLAAAKATATNGYRYWHY

SEQ ID NO: 22572 - protein, 71 aa, Candida albicans
RNQIKPLFIYCDKFSTKKVWETQRGIIQANNDNNQLFFFLHLNFELNSVIQFQQQQQIKIFRKNEKITGLG

SEQ ID NO: 22573 - protein, 73 aa, Candida albicans
PITTTNYMCIYYVLQNLQLPKLSCCCFIVSPHTLHKNEYLCITETWSDETKLNPYLFIVTNSRLKKCGRHKEE

SEQ ID NO: 22574 - protein, 62 aa, Candida albicans
WDIHMVSAFEFDIYSHEQDVDLVLSNEWRANIFHQQQIDCQTYSVLPRVLLFVGDRQLDQDI

SEQ ID NO: 22575 - protein, 71 aa, Candida albicans
LYIETQTIYHLMTFQSNLSSLEYCYMIIEKNWKVYTTSIVTQWKRARLITSKSLDRNQAMLSIIIFLSVFF

SEQ ID NO: 22576 - protein, 63 aa, Candida albicans
SHFLFMYMFLFISIIESNEERLKRLNSKIIKKKKKGVVVVVVKSRIVLESYINFFFLFCDFFL

SEQ ID NO: 22577 - protein, 99 aa, Candida albicans
KCIDLREFFKKKMGSSTNNTQSKATPSVLENEVNSSKSSVVSSTSSAKGLLRETTNHGTMETSSVQISESESRPSKMVLVLTLASSISGLSHHGAGKSA

SEQ ID NO: 22578 - protein, 358 aa, Candida albicans
  UNSURE (273): Identity of amino acid sequences at the above locations are unknown.
LSSRRGRKQLQSQQRQSQQRQANPHQQHQQNYLQQPQHNNAQLHLNRNLHQLPQQQQQQQHHHYQQQQQQQQQQQRLQLPQQLRSSPQNRSFQTQPNEQQRVNSLSRSTDATPLLRQIVLDFGTSVPLPTQSSRPTLEEQGSFNLNLLRHTPNLQTVASHSPWSPVATEPKNRSFSDSNIAVVNGLNESDPIEDRPLASLSGRSKSTNNMSNHNTSNVSSSNYQVSEKQQQVHRLQSINANSNKKEDTEVETTTDTNLQQGLSAENTTDEQNXIRCNVQKTMLAIKNSDPSQNHGQVEDTQTKNSINGTITGVGGNAVFEGNLKLQTNSVQSHSNSPRKEQNSTSVVTKWQSSTNSNR

SEQ ID NO: 22579 - protein, 449 aa, Candida albicans
IKLIQPYNHTTTQPTTHNPQPTTHFPSIMSIDDITDKILDFNNSSSSNTLSSLSTGNTRIPPQQRKLSHLVSNSPSSKLYQKSFEDDNVTNNTSDINNKHKNLNKPTNDELTTRIKSIQQLADRTIDSILKGLPLERSFGYLNYEFTKLCRYKHVEQSKLSDLIFEKIINDFKTNLKPSIIEILHDNYQDTDSIIQLVKNFLNLFTNWYFRMSDLSKVFIYLDNHYLVQHRTKHPIMLFAIDLFINEVFVEDKQLAKKVLNTEFQLLCKWREQIEIEMEIDDDDDEENDLINMDVIDQSLLFTTVLVDLHNQGFKFDFNEQLLSSIITHYNHLKISWLKNDATTYLSKVLGTINENLRFFKAVGKNINFIKNLFKKLRWNLIFYDFNNLLPKVLPSLLKNEQELGIIYQYCCHSVEDFGYDSILIFIYQWGVYTKSVFESIVDVYDKFD

SEQ ID NO: 22580 - protein, 71 aa, Candida albicans
  UNSURE (68),(69): Identity of amino acid sequences at the above locations are unknown.
NNKKKLGRLEINKILKKLSKFENESTNGTNISTDICEIEIKEDNVTGKGNCKFGGIHLQRNVVDREMXXES

SEQ ID NO: 22581 - protein, 143 aa, Candida albicans
LVGISSFSAMELNSILGVVLDTEEDAVEVARCKLLKHECDDFETTSVLERVREFVNCFVSDLPDEGITKLDGFLNGARERFDDGDPDVAFVLEKVGDGDLELLSNVFEDDFLNALFLIKIGEQQLASSTFVSSCDAAGEKSSK

SEQ ID NO: 22582 - protein, 193 aa, Candida albicans
SIMLHNEDFIPNFLQDSSSASMTHTLRVKRNRPKSSYFEDFSPAASQDDTNVEDANCCSPILMRKSALRKSSSKTLDNNSKSPSPTFSKTKATSGSPSSNLSRAPLRNPSNFVIPSSGKSETKQFTNSLTRSRTEVVSKSSHSCFNNLHLATSTASSSVSSTTPKIEFNSIAENDDIPTNYDFDLHQAVEDQR

SEQ ID NO: 22583 - protein, 64 aa, Candida albicans
  UNSURE (54): Identity of amino acid sequences at the above locations are unknown.
KDNGKKKSLAKHALNFIHRKNILLRELLGVWKLRKKRDRKSRRKNILQERTNYXNSGMGIKLGY

SEQ ID NO: 22584 - protein, 271 aa, Candida albicans
QHNKLVMSELYFLRHGERIDHALREDPDAKPILEDYKPYDPSLSQNAIPQIEKLVDEICSLTQAFTDLESTQRKNVFIHFSPYLRCCQTADLLITDLKASLLKKYPNYKMRFQLLCDFALSEWIHDKMKNKPPFVDSDDAYNMYTPNLKSLKNKSACSMFRPTITLGQYNGLDLSYKDYQTRCKDYFKKLLATYEKPMYIKNKDIIIVVTHGYAVNNFLSYFINHPIFEELPEAKANFAKRVLKDDIKDVEDENDPANYTWKLVHDALGFD

SEQ ID NO: 22585 - protein, 61 aa, Candida albicans
LEEELLCKQQLRLKNFKPFVSLLKDWQYEDEERKKKKNNERRQRQPRTQKKKLFIIINSIN

SEQ ID NO: 22586 - protein, 92 aa, Candida albicans
ALVGRFGKSGSLAFCLPIVVLATSDGPFDDFDEPEAKAIFIADDDVVEDEEEDDDEDLDFLLPVFDFTNESSNIVGVGGHAISSKATIPSGN

SEQ ID NO: 22587 - protein, 65 aa, Candida albicans
SRLIQFTILNNFPPSHMNIGLLKKNFFCYREIKKYLQDEGCKLLSQIKKRWRDSNFEIKTGGYPI

SEQ ID NO: 22588 - protein, 70 aa, Candida albicans
QKSGSQRIRMLPIFFWSNMKSFRSNQNHLNTLSPLLINIKNTHLVTFTFAKPVKTTIFLIDGIYIIIMVI

SEQ ID NO: 22589 - protein, 149 aa, Candida albicans
TMTTSPTLTPVTMFRLKSLSLPILKKRTTGITPFFSKRLISDSVGNGSKGQPTWPLFQSLINSFSRESIKLFGWSMALLVALLIWPVGIIDLSNKIDHVPKDKGAQVQLHRIEGTIDKYEADVEIPQTFVSLDKLDEEEGEDVTVDDEE

SEQ ID NO: 22590 - protein, 66 aa, Candida albicans
EIMNIIECCIHRKDYIHEHRTELPSSFYFTFNSGNIHKLLRRKQMYQALAKTKIVKRLQDNLIFPW

SEQ ID NO: 22591 - protein, 114 aa, Candida albicans
GHFKNGQIASKLIISIGEKMLFIMSFVIVGYQLMSGSISKVLPKKSLAVQGEPCCTGTTKTWQQQQTRQFNIYHTIIILTFAERICEFLAGVPRRNQVSLSYFLKQIMFITDDH

SEQ ID NO: 22592 - protein, 65 aa, Candida albicans
  UNSURE (13): Identity of amino acid sequences at the above locations are unknown.
KNYHYRTAKFDQXVLLMVYLPLIVAVVAYWSYSMFFPILMMFKKLAEQYLIPPIRRRNILKTNLF

SEQ ID NO: 22593 - protein, 85 aa, Candida albicans
  UNSURE (57): Identity of amino acid sequences at the above locations are unknown.
VYSKLYSGCNGYLFLFIDDWMVGKQERADLQQYKQIIFTVSISIFIVISGIRFGRTXKKHSNSKSYKKYLPRNTLLLLWLVPSLL

SEQ ID NO: 22594 - protein, 97 aa, Candida albicans
LAHSNIKQFLTLPFKETRRAIVLELVVFIFLILIYSSPFCKHLFYSKSGLFPSSPHNTLGVGLSLIFFFCYLSNSFPNFFFQVVIARKELERFVACV

SEQ ID NO: 22595 - protein, 72 aa, Candida albicans
KKYSAEYYYTYTHIHTEATLLGSGSKVDKGVVKRTHYTNRRIHQPTHAPITITIVAVRVFVFSTYTNNLALA

SEQ ID NO: 22596 - protein, 178 aa, Candida albicans
TMPTLKVAYIPEHFSTPLFFAQQQGYYKAHDLSIEFVKVPEGSGRLINLLNSNEVDIAIGLTEAFIADIAKGNENIHVLDTYVKSPLLWAVSTGSNRDDVTDAKQLKRIGVSRIGSGSYVMSFVLAHQLGVPSFDQFQVLSNFQNLRDSVNLNDGVYRSDAFMWEYFTTQKYHDNHEI

SEQ ID NO: 22597 - protein, 104 aa, Candida albicans
FHAMAKLIDLSTNKVTYVVNEPLTGNAVASSAKLDMVANITDPTKIHTINKPKGPAWANELPEDISRPLPIDAPNDIHVKCLVFNRLDNGELAVINASLSNCVK

SEQ ID NO: 22598 - protein, 106 aa, Candida albicans
TRPTRGVVKYFQQQINGVSYPNYTGVYIIRKTIDPAEFLFKELLMEDELGNAVKTVNGPSFAEYLTSLHKAIRVKIDSDKSSQSIRQLVSNVEHGNETLAQRYIHF

SEQ ID NO: 22599 - protein, 80 aa, Candida albicans
ILYIFFLFFPFFFTTSIYIPPPIKRRNYRKMLSARPVLRTAARTATIAARSSLRVVCIEHYSTWKGATEIETNPMQYYFH

SEQ ID NO: 22600 - protein, 83 aa, Candida albicans
IEVVKKKGKKRKNIYKIYVEKKFVEMKESLVREKKKNCVLFLNFHWHFTEQNSPSQFDWSTEKCAVTCPQVLNMDKHGVERRN

SEQ ID NO: 22601 - protein, 79 aa, Candida albicans
  UNSURE (52): Identity of amino acid sequences at the above locations are unknown.
LTDLIWEKTNFIFGELNFNHFNKFKALIPTYQISLLFCCHYFFFPFLSFFLXWNKVIADKINNSHSPIHITLTFDKRYI

SEQ ID NO: 22602 - protein, 69 aa, Candida albicans
TLSLFFFLSFFFFVLVRVIYITSSVHCSNNIKTTIRQKRVTESERVKSHTIENTPLRQYLEIYKYWSLF

SEQ ID NO: 22603 - protein, 134 aa, Candida albicans
IEFYSDVILLCYYCCKRVVQCEITLSNRLTILHVDYVYKEWSTLILIERHRHPYPIGEFLIFSFYLVCGSCVYVDLLIVRNFSIAASISKKGEKKNETGKKIFLLVPRILSFQQRYIYILLLLLLLVIFFELHC

SEQ ID NO: 22604 - protein, 393 aa, Candida albicans
GARFLPAPVAEEKSKCGKISIKDLESYIFNNSNDSLIDKTKMGGKIIYLDLKPLIDINSINYQTLEDLLIFKKIDFRFLNKFQFYIHSLNVKHWQFPLFMSPFFIRFINKEKTKVEIDDWNRRIMDGLDLDSTMISAATATTTTPTPITNNNHNSRVRGHHHMITKPITTPIITTTTTTTSSSNSSFSPFTVDVKHFSYIIQNLKNKIPGFNQWQINQQKIFFNNIKNTNFQFTLKGVDENCWFKNFNFTKLNLKTYYLYQDDYKLINLFNFNNLIKLTIDFGQSPLNFIPHWCQFLQNLNNLEIFNLNIGKICLIDICLIILKLNRLIEFNLKTFKCWTQTFWKWLILKLIKQKYHGHHCSSHKLNQHKPKNHCSSPDKTKEFKFTMQFIDS

SEQ ID NO: 22605 - protein, 87 aa, Candida albicans
  UNSURE (76),(78),(83): Identity of amino acid sequences at the above locations are unknown.
PKERRNGTGEEGQHPTSTRGRRPNIKKKRRKKKQETKKKKKSPPENEDLGRKNKNKTKENTNTKNKERLVTRSGPXRXRRAEXENGM

SEQ ID NO: 22606 - protein, 60 aa, Candida albicans
  UNSURE (4): Identity of amino acid sequences at the above locations are unknown.
ARNXVPWPACVKATNGLYVAKTLALATDNNADKMTALKIEGKTLIPRLEIAITKGEHRPI

SEQ ID NO: 22607 - protein, 72 aa, Candida albicans
DQFCRRVFICRKKKNGNVNAAIHLFASISPMHGDEAKKLKYDQHQLALNQHHYACSNVKLKLEGRDAFSCTL

SEQ ID NO: 22608 - protein, 107 aa, Candida albicans
SCNYCFFNVMVPPRRKKPKYEPVEINSSFDEISSDSQDSSSFEHWSIQPSPVKKSQTTINNNQQWIDKYRPKTTSEICINPTKLKQVKESMMKMINKTSNTRVLVLS

SEQ ID NO: 22609 - protein, 548 aa, Candida albicans
LVVNIFLSFVQFNKSKVKWVWKKKNIYIYFNSSILIILDISHSPIQPLTSPINLMFRRIHPILSKQSNALQTLKSGIIFRPLSFITKPTTLTTLRTTPKIISHTLIQSRTLMSTKTTNLGPFKFTLQILTGVYCGLLIVSFGLCYLLYSDANQRQNIPFELSLDDHINAVMAINKDDVCESPRHATKHYRRLLIDLAKQELGDTTTIDESKFDNRYDVPILSTDFLIHNKSIKFINFYIDMILRYSKCLLSKGELDIAIKMLTRIVVDDDFIFFKLGDAEKLSSSSRVLAKITPDITKKISILQRSIDMLIETNKSMQIDNDYILLENSKISDELINCLNDLASNLAKLSQSQSQSQSQGQQELLNQSLQIYLSELRSLQTIRLKIESNQANQATYPLFNVDRANLIGMINTIKAHISEIMWVKGHKDKAINFLEQILQELYYDRYSDPKFGPILLNVLNNLEIMYHNLHKPEDVKRCQNLKHDVSIYEIRNRFDIPWYDRVMKRISKTIYLRTPIGLVDKGLRDRFEPRARVKELDEFEDEDDENRS

SEQ ID NO: 22610 - protein, 121 aa, Candida albicans
SPVSSINSSSEKKHDTKPPIPPMKRNTTLNDIKLSSPSLTNSIKSGKVLKDDSDVDTMKKLDVKPMIPKKPENLKSIHKDGKLDNNGNSTSQNTNGGESGGGGVATPKSMASWQPLVPGRK

SEQ ID NO: 22611 - protein, 93 aa, Candida albicans
SKDFRQLISKKEKEEVNENNQKNFFSSSIFNTLHFLLDAIVGEYITRPTEKLHIDVEDQIKLKIGRIICRLLSKLNYSLFSSPSPSFNQLMKL

SEQ ID NO: 22612 - protein, 75 aa, Candida albicans
LTYPGPFFFPSFYTYQLRIIEKVWPMKEEEKRDQFSNYNHFDCQTRLKWFLILKYVYEYMNYCYILMTKKCRFHQ

SEQ ID NO: 22613 - protein, 482 aa, Candida albicans
LGSWLGTVKSYQWLYSSKAQKKTLSTILTFVDELNSEMKDLCSDLPGPMAILFYDEPGFLSNSAINSEILLNLDNGYENTLMIQFEYFSHLLTINRLLLQEFPQDMDNKFLTRRCLHHKNIANRSARTILYIARNLAEKKVNFILINWFSYSIFAAFAHLGSMCLEDPQSPEAISDIDLLIDISYSFLAFENQSFKVSRFSLKRYVYDIYTRCILKLYLKVANEETRNMFHEKYKNLHNHLRLEETFHEFFVNEKLGFDPSKTYQALNKLFRPFWINSNERLNCTQVNAADDAASNQTSSTPLESLSSSSGILYGNSSSSSTSFQPPIVHQRSSVSSHRFDYTQDFPHNCGKPLEISYLVHPQMKHFDAAIDSATQRSGSSNDKELPETFDLLAISAINAAQMQQRQQQQPPFFTPPPHPPLPEQRDQQPLLLSQYQQQPEQQPEQQQQPRSNRFNSNFTSFEEMIEENYAGDLNFPNMFYN

SEQ ID NO: 22614 - protein, 115 aa, Candida albicans
RTLISPKWFLHCKKQASFIVNQALDECNNVKQKASMIFNNQNEELQTFIKSSNDKFDVLAKQTNKFFNNNFKIFEKNDPQPNNIADSSFNIENLEGVIYERSFEIDIDDYDSSID

SEQ ID NO: 22615 - protein, 68 aa, Candida albicans
KFCAGGFTSLRYKTNQLRRKGYQMKINIKIDTPTVNKLITDPNVGNINNVHLKMIYFKLQLRSFPFLF

SEQ ID NO: 22616 - protein, 171 aa, Candida albicans
TITMRFAFTTVSLSLLLSSLVASEAASSDVQFLTALVGDYQDHKTDYIKFFATAKDVPGDLSTLATKVLTYTDDSYTTLLNDDSLNVSNLEAYATSLPWYSRIQADAGGKGSASGSASGSGSAKSTASAEKSSGSSASASSTAGGSSSKGGVSELVAPVGAVVGALAVALM

SEQ ID NO: 22617 - protein, 81 aa, Candida albicans
  UNSURE (1),(2),(3),(4),(5),(6),(7),(8): Identity of amino acid sequences at the above locations are unknown.
XXXXXXXXGGGGVYIKATAKAPTTAPTGATSSLTPPLEEEPPAVLEAEALEPLDFSALAVDLAEPEPEAEPEAEPLPPASA

SEQ ID NO: 22618 - protein, 70 aa, Candida albicans
NICTAFRSFLTLFSVWIKGIQHYEAKIHAIRSSNVGNHELIFGYVELLHHHNWLDFEISFIVLPNNIIYT

SEQ ID NO: 22619 - protein, 93 aa, Candida albicans
RSVVLLVNNCTNEKPTSQQQNQQNLLVKNSIYRLMIHPLPLMLQGLPVFFFLVLFILPYQSINELKGFQEFTTTSSFIKKILLKGKFIFLISK

SEQ ID NO: 22620 - protein, 68 aa, Candida albicans
NPRRKKKKKNSHTTESLILFDLFKNFYTQPPNYHHIQQAQFCFPYSSLHVDSLTHPFVYTPINSHIQS

SEQ ID NO: 22621 - protein, 69 aa, Candida albicans
LIFTSRAFTYIHINLFFFFYLELPNKTNISRLKKKGKFKEDTKFLFMSNHIVSFSYLLDYKYLINWIHQ

SEQ ID NO: 22622 - protein, 67 aa, Candida albicans
MSTSKLKTKISVFQFFFFLEIHFNQLKKYQLSVVNINININTGMKLMQNGKIEYHNQSVKAYKLECL

SEQ ID NO: 22623 - protein, 65 aa, Candida albicans
ECHVTRPVSTSQKKKFTNSLAKSLHLETRFLIDIIILFQSNRGSIELMLLSTLDNLHHGAGGSAA

SEQ ID NO: 22624 - protein, 129 aa, Candida albicans
ISTLHIKTNHYFQNQTSNDHEHRNNMKWVNLLSWSLLFISIFALTESDSKHKHQQRRHDSNVYLLSNGKVVSNDDTTLLTKHEAMTYLDTFLELDEPYVKLGDNDQLIDLLNGLWDTKKLGSPKLIVNV

SEQ ID NO: 22625 - protein, 74 aa, Candida albicans
RRFDKYELRLTGFDLVPERVVVVDMLQKKKTNNYKSINYQTDNYKYFRNTDYRTRNSFNYLYSNLKAIGICIYA

SEQ ID NO: 22626 - protein, 129 aa, Candida albicans
LFVFFFCNMSTTTTRSGTKSKPVKRNSYLSNLRHLTNKDVTKAAYTLLEAFAEDDLAKMWVCHIEDKAERQLCELTLYEAYIKQHIAKGIVIGQGETESGFETVSIWSHPKSEEGGIRFVHKFNGGWIR

SEQ ID NO: 22627 - protein, 93 aa, Candida albicans
INSFNQELFNLIKSSNDNILNFANYISTTNNNNNNTSPKTSNSNSNSNFSYLIINNNPILNLSICQLFKFIKLHKLIIDKLPPPTTTTKTTIT

SEQ ID NO: 22628 - protein, 77 aa, Candida albicans
TTITKTTITKTTISNDLDIDIDRLNNQLSISFNLLNLNLQNLKIGNMINQILQNKFNQLYKFRSHFSPWDERYANEN

SEQ ID NO: 22629 - protein, 87 aa, Candida albicans
LEGLQNWEKILDNPRLPPHPINNSSKLALKSIVYAPLLHKKSSLYCHFKGIVILKWGGGTFLGEKEGRKKRSEIPVTGYSRIVFSGK

SEQ ID NO: 22630 - protein, 80 aa, Candida albicans
EIVDLDYVKDTPDWAVWGSQWAGFNPENTKYDRKADHLKQKAITDDHPYNYLKRHQLPLTTPINCSCPKQYHLGLHCWVG

SEQ ID NO: 22631 - protein, 81 aa, Candida albicans
ILILFLQVVVVEVFLGDLKFISAFTRCYRDVFGLLIINYSYITPFSLSFVSQLWLSQMPQQYTVLFSNHNYKSSTIIPVFD

SEQ ID NO: 22632 - protein, 88 aa, Candida albicans
INYPIMLSQITRSSVRGIRLFSGSRIALTEGAIPQSKDAFSEKERAQENVYIKKHEAAQLKKLKEKLQQQEETINKLEKELDDHKNSK

SEQ ID NO: 22633 - protein, 64 aa, Candida albicans
TWLDQFDTQTTRTTTNAIFQLYIYIGNYKLINLTNHQQSYSHTTYCYGNNNQELFFIKTQLLGW

SEQ ID NO: 22634 - protein, 69 aa, Candida albicans
EIYIYIYNIGSVERDRQKKEVGGGGGDVRVHSDNYPAYKYFLLLRLFFFLFFLGINLCFVFCVLCVYCG

SEQ ID NO: 22635 - protein, 127 aa, Candida albicans
YTSKQLLLPAMVKQQSKEEIALQLKSAVYLSVAKIVEAKLEDLNNDNAATTTTESNNKNNNNNMLIATPTFIAQLVELVYNQLINLGEDLELFCQHANRDIVEPSDLFMVTRKNPTLQQHLKDLLQQ

SEQ ID NO: 22636 - protein, 62 aa, Candida albicans
RQLMFLSFSQQPSFFKESQCYIILEINLNELYITNLKFHKQFGYRPGGGLTLEKNCYVENDF

SEQ ID NO: 22637 - protein, 66 aa, Candida albicans
KNLAVERKRGTSTVFRDLNIDIDKTFLEILISKFNCKLVFKFFSHYPQTQMNLIVETFKKYLNRVD

SEQ ID NO: 22638 - protein, 73 aa, Candida albicans
PPNHRLYSNSCIEMIYCGWPIEITLKKFKIYIIQSYNSNQILTITQFPLISQNTSFDLIPFIVVASLSNVVVK

SEQ ID NO: 22639 - protein, 72 aa, Candida albicans
LRNTHDHVSYYEVMTYSLKPTLEEGRNIYLILGTRSTTFLFQATFIERNLEKNRILHATTIPSNLQYYFVAP

SEQ ID NO: 22640 - protein, 75 aa, Candida albicans
NCLGLVHECLHEKVIVVPGFFFLINPQNLAHMEEIIWYNYVRISYGPELHHLENGMDGIERILDRFGCLPYDINS

SEQ ID NO: 22641 - protein, 126 aa, Candida albicans
TMEPRLGTHKYSQNTQLNAKVIMSGTWFFQSEDDFIIEFFAKYFKYIIVQSSHTLWYDNFNTPIYSCATEKTETAVISNIGCLKVFLLVAKSKYGTFQDSRWPSTTHNSVNHLPRNKWSSFTTNSS

SEQ ID NO: 22642 - protein, 91 aa, Candida albicans
ILKFIHVINKLTKHQEVRHKYITSVIKVLKIFYINSTSFSFQISTKSILHTRLLHFNFNFNCKHKFKNLYLHHSSYAISYFDNCPGSSAIP

SEQ ID NO: 22643 - protein, 62 aa, Candida albicans
RYFTLILLLFLFKYQQNLFFTHVYSTSTLTLTVNTNSKIYTYTTAPMLYLISTTALEVPQSP

SEQ ID NO: 22644 - protein, 136 aa, Candida albicans
YSCFLGILNNQSKSMKTLLFIYLQLLLLLLIIIGRVVKVEYLHLVVEVETSTINELCLSERYDGYLGSFYLNTTFAELMLKEHHNKKKLHPSCPLKWSSELFTMHPHLHLNILAPDYCNIRVGKYGKYFTFGVIGH

SEQ ID NO: 22645 - protein, 70 aa, Candida albicans
IFLLRIIATFGWVNMENILLLGLLAIRSHKNLGIMKGEIYVLPFTKIFLPFSRELWWTNTNSLGLCSQIC

SEQ ID NO: 22646 - protein, 135 aa, Candida albicans
STTMLGRLFKQNNNTTQPHNPHHQPPIQSSSNPTTPPALTSSYEDSYTREILYGTHNANQLKPYQFNSKLFRIIISQDGGNLRTKQVLYDSANDESNIYSPTKSQSYSCLMQHQQLLPLQRPTSEFSNFQKACSG

SEQ ID NO: 22647 - protein, 297 aa, Candida albicans
IEMTICLGCGPPSNENHSATKLHVLPPLTNSMYEPYPAVLITRLFSISDGEFIDSSLFSSTETKEWQPNPALVVKESSIRKVSLKDDTSKNNNVNSRFAIGIVIPLESLGSLIDIVFNNWHEIIHYTINLQKLIYKKLLVHLNQGLTYDSTHSYTGCQYLINKRIQFPNFILQHDNEIGVQKLKLIKTIHYNYNVPKLINSNTLMKSSVTKDLFQYNPMLVNWVLELLNWLEFKDGRYSDHSNSFLGSLFAILTPFKKLLILKPFYNSSCAKKEITRVVVMTGNPVIARKLVFILNG

SEQ ID NO: 22648 - protein, 91 aa, Candida albicans
EKLPQHDQGTSNVFWCTFSGISRNSSGFDPNSESKEESGNKQMPPVVDKPLPNTSDGRNQAGPENCPFSTQMSIPVIGCPACNDRAAQVWC

SEQ ID NO: 22649 - protein, 96 aa, Candida albicans
NYWNSSFLFLLLFCEIYLKSLLFFFSNINKRKNNHIHYDFIYKPLVNRVVDFCTISMVFVTNNYLLAKKKWYLPNWGGSQTKIEATPIFLTTRKSQ

SEQ ID NO: 22650 - protein, 122 aa, Candida albicans
KEIIGDPESPEILTSFVFTVMYGAALHSQAGHSNNCARAHNGNNKTTTTTPTTKCVSIEKIKTSHSNGHFCVILHYLYACTISMMRMIAILTGITMYNCDGEKTTKEACETKKEKCDPVCQV

SEQ ID NO: 22651 - protein, 68 aa, Candida albicans
IFLLQQKHVLLTSYTGSRKKQDVAKEEERQKGNSRIASRDQPRNFLTGIFSSSEILELLLFLFVNRPN

SEQ ID NO: 22652 - protein, 81 aa, Candida albicans
EFCLLATPAKASNQSAKALMTPIIPPATFTLSLSDKNPAAKRIMVKSYVSNAQKNDKVDFTTHISNMVVNIAHPININPIA

SEQ ID NO: 22653 - protein, 61 aa, Candida albicans
KRDWILVIVIYLILSVLLHPSSKNKNKNMKERKFLILNILCDSNYFVTILLLIMVTLTRHN

SEQ ID NO: 22654 - protein, 60 aa, Candida albicans
RKEIFSIKPKKKKMKHPFNLILCNIYYYKNRVDQKKLQLPDDDDDINCSNKVSYDGLKLP

SEQ ID NO: 22655 - protein, 60 aa, Candida albicans
  UNSURE (52): Identity of amino acid sequences at the above locations are unknown.
NGRGHLYVFTTGLEGAAQSAKKTRKGLDGTRTQQTTGRERSRQQSGVDRRNXERGYIDEQ

SEQ ID NO: 22656 - protein, 143 aa, Candida albicans
RPVNDGQQEIDVGDATEQPEKGEIDDTRKQSNNAVNNTETQETATDDAFDTVPLEGDENIATAAKETEPTSTEPTESVDVTNTNNSASEEVGKDDNDDEDDEDEDADNEGKSNETPEQSSEGSATGSPSKKKNKKKKKNNKKK

SEQ ID NO: 22657 - protein, 71 aa, Candida albicans
TSEKETRKKQKRKDKKKTEERKGSQKKEKKNHSTSTNRKQAEEKEKKKGKGEGQRSQKEEKSNLKKSIITP

SEQ ID NO: 22658 - protein, 70 aa, Candida albicans
KWNILWNSQINCLLPKLETDLNNNNKFHHDCQTNLQKFINNNDICERINKFQQDNNSQLDKINPFDLKLK

SEQ ID NO: 22659 - protein, 128 aa, Candida albicans
TSSINGITNDIQQYHNQMNNNLTKINQELTQIQQFDANTMKISPIKESSRIPITTANMPNNQFKPIKLHRSNIACGGGGATGKSLSPTRIPTLQRSKSNVPEDTSPQDSTTTNNNKKRKILQTMDNLL

SEQ ID NO: 22660 - protein, 70 aa, Candida albicans
PFSNKIQINFEKTENLKSNEIPFEVLTYLQPNRINDDDEVHDVHGGGGHVHDEDQMNDDDYDYDDDDDGH

SEQ ID NO: 22661 - protein, 67 aa, Candida albicans
THILVVDYLEEEQQQHKYDQDNNLSKYYVSYHHNDDDVDDDGDGDGDDVGDVIDYVDEVYLINYEET

SEQ ID NO: 22662 - protein, 123 aa, Candida albicans
VKTPVAVVDSEDEAAAVVEVLDSFKVDEVELAASEEDSLVAEAEAEAEAAAEDDSSVEAVSVAEETASDEPAAEEEALAELDSLVVEASTFEDLPADEEAEAEAEAEDSSLEADSDSDSDDED

SEQ ID NO: 22663 - protein, 92 aa, Candida albicans
CLGVDARKTVKKKQRDLCSIMSSNSVLNFTNEKIVEKKNVRSRNNTLIIYANSNVYKLCINFIVHQQLLKKKNTDEYINPLSKVFSPKNSNL

SEQ ID NO: 22664 - protein, 67 aa, Candida albicans
KTSSLFLHKLQNSNMSTSNTQEDVYIEYLNYDWDSFQEFQDGLQEIMDNYLQNLQEQDSSTRRARTM

SEQ ID NO: 22665 - protein, 82 aa, Candida albicans
FEFNFVPTFNNSPYYFFFFFYSTLQQFLSYEIKRYLCIYVVFFFFFFTLLYFYLPVGISQVALIISIILLLIEYYLNNNRIE

SEQ ID NO: 22666 - protein, 70 aa, Candida albicans
  UNSURE (17): Identity of amino acid sequences at the above locations are unknown.
SLRVPTNTLRGLAPTPXGEDPTQIYSLTKKKVKVKVKLKDKKIVVIVVVVVVREDLQERKRERRRRRKLI

SEQ ID NO: 22667 - protein, 93 aa, Candida albicans
TTNPASKKIQKSLQPTLNPQTATILTTTSINSINRLINYSKHLSFALHSSQLQTRTSLSGLTLPSTIDLLNIFHIIIRNTHPLPPQQNSPLRT

SEQ ID NO: 22668 - protein, 92 aa, Candida albicans
VVVVWLVVSIISFFYPVEFYILSCNLNERNNSTHTLNTLSISLSLAIYINIIWFALRQPTQPAKKYKKVCNQLSIHRQQPFLQQLQLIQLID

SEQ ID NO: 22669 - protein, 104 aa, Candida albicans
FGIEIEIQSTTNISSSLTSSPPPPSPMSSSTNNDKLIKGLLKRYKKLEASLNKFNSKKYNHSNNGAILKGNILRTSLLPFLRISTYQLDELFTKDTPVYKSLSN

SEQ ID NO: 22670 - protein, 65 aa, Candida albicans
GNVGCRLNFNFNTKLFKKMQTKQSKAKQIKVKLVENKPNSLLKKIFIYVVCKNKPNKQTKKAPKK

SEQ ID NO: 22671 - protein, 77 aa, Candida albicans
VEILKNGNSEVRSIFPFNIAPLLLWLYFLELNLFNEASSFLYRLSKPLISLSLFVDDDIGDGGGGDDVNDEEMLVVD

SEQ ID NO: 22672 - protein, 75 aa, Candida albicans
MNIIKQQGKNIAVKNINTNSNKKTTRRMEIWRKFRFISPCLIQTHRACNCKVYKHTHVEIIEKKKNTSKKSPMSL

SEQ ID NO: 22673 - protein, 79 aa, Candida albicans
HVTKSIFQHFAIHSTNHVEKTPFTKVMMMVLLLHDVVYFSICNKKIETIATTKTEKKKKHKRIALARRVVHTFAIICML

SEQ ID NO: 22674 - protein, 62 aa, Candida albicans
HQQRRQRRKFHVVHERISKFFSFVQYFIAFFLQFLNYTFFFNTQTSIETNIQIVCSIIDDYL

SEQ ID NO: 22675 - protein, 82 aa, Candida albicans
TVDNYNMTETDNQEKLNYKYLTNCVPFKNRTTSKLQSQNYTNINTQLKMAVKGLGEVDQKYDGMFFIIVVPTKIQFVHSMFI

SEQ ID NO: 22676 - protein, 165 aa, Candida albicans
RIRRSLVKIGGATAGAATTNVFGSRPTTPAFNFGGAATTTAAAAPSGFGAIGNKPPLFNFTGSKESTPDPASVFGQQNISGTSTPFSSGGVGTGAPGVAGNVFGQPGQQPGIFGGTTNNNSFTFGGAPSAPAASGVPGVPGGTNMPVVTPAPNPRRILHPRSRRR

SEQ ID NO: 22677 - protein, 64 aa, Candida albicans
MSNINQQKLINNNKMRERYVNVGGGPFERIYTKLWGGEVCVYQNQSHMGNCYIASAGTFFFWFH

SEQ ID NO: 22678 - protein, 63 aa, Candida albicans
FVLLRVDLTGLREIVIVSEDTELCVDDANGTLNGLDKRVAESVTRGGRLSFGTPAPEHKGVVN

SEQ ID NO: 22679 - protein, 82 aa, Candida albicans
TEKLKSQIDIITITIELIKLAAIKRGGNGNGNSGGNTILQNILQLINDLQIEFNEFDNNINELIKNLIGNNEKESLNKLNII

SEQ ID NO: 22680 - protein, 72 aa, Candida albicans
TESNGEDGNSLKERRAGQEARGMRLTDKKLPVKQEAGFRRSRCEVTEGPDQNPLTDGKQARGQSERCHWRSK

SEQ ID NO: 22681 - protein, 83 aa, Candida albicans
ELKLQDEVGQTALQSRMARQGRNYELSKKSEEVNSLCIRVVIYVGLSQNWRVVEWPSSLEVNQMETCRICVAHGCLTSWCTDV

SEQ ID NO: 22682 - protein, 77 aa, Candida albicans
LIEGNGRFLNGGLEKHRSSPKSVAKKTRGLVFFNFKGGTIRPFIQWSLPIDESTGWGEEIGDSQKVRLSPMERMGIH

SEQ ID NO: 22683 - protein, 78 aa, Candida albicans
NMCVCPCINKVTEEEKKEFFFHRFLPVIVKSSTINFFFGLQLEGKRFELNSFQEKLPFLLPAYLFSRSIFEIYNVSTD

SEQ ID NO: 22684 - protein, 72 aa, Candida albicans
KMQQKQEFPILTTRKQLEMLKLMQNFLFFFVNFAANSKTNLDSLRSETDYATNLLIIVVTFFYRKYYYNYLF

SEQ ID NO: 22685 - protein, 74 aa, Candida albicans
KPKKNLYNVKKKRLQIETPSLKSSIKKNTKKFSASGYHCCDNADVNGTNHQGSLYLPILLNLVCWWISHFFFFF

SEQ ID NO: 22686 - protein, 83 aa, Candida albicans
TITVNNYMSLYLHNFKCQQKSRLYPPFFFVVLRVIQLTPSNHAIYQNFENDNSMISPTIKPLNLLFSFIPIKNNSEQNFLLVV

SEQ ID NO: 22687 - protein, 65 aa, Candida albicans
HAYKDQVTVEVSSEIFWSNYIYVFIIVNAVPFHVYSRGKEKESDQLNPLINGLVLLNRLGIFSCV

SEQ ID NO: 22688 - protein, 71 aa, Candida albicans
SFILTFIYIYTYINRFYCFDNMSASPPEETPLDTTSSIPEEPEQQQQPESSIEHQDDADGVFTTELPVRIK

SEQ ID NO: 22689 - protein, 86 aa, Candida albicans
IKMNERTKKKLSKKKKKQPSPLKQQQQQQQIQNTVTATIRTTTGGLFYFYFIIFYFLSLQPIFFNHLSLLSYIYIHTLIDFTVSTI

SEQ ID NO: 22690 - protein, 74 aa, Candida albicans
YLKWCGCGLISIALRLMAYLILYALTLKYVEFYTRLSTQYLINKNVYWIGKFLIISIFGGEQYMHNGGRKSRFF

SEQ ID NO: 22691 - protein, 72 aa, Candida albicans
PIPQYLLLNWSEFFADMVVQNTPRDKTKKINVIHIHNTRLILISKVVWLWFDFYCSEIDGLLNLIRFNFEIC

SEQ ID NO: 22692 - protein, 65 aa, Candida albicans
LLNNLFYNTPDPPPSGYINPRTFIKSLEMEINSFILVPRKKLLISNKLLPKLLIPYLLNFLPISG

SEQ ID NO: 22693 - protein, 73 aa, Candida albicans
SIFVLFKSFFAKQLVVAKKKKKMTKISFGNKLFFLVLARLLPPPPPLKRKREKSKYGNSIEYNRTSILSTPPP

SEQ ID NO: 22694 - protein, 107 aa, Candida albicans
RCLPPAVNNEELHRLTIPLFFVKGADKLIGFGMLGVAAFVFTYYTAWVFVLPFINEDNILNQFFLPRDYAIKLPILLLFIAALGVGTFVGKVLIKNQQKQKSKKKAQ

SEQ ID NO: 22695 - protein, 235 aa, Candida albicans
FSSIFSYYYFLFFFYFCLSIPSQIINIKTEMDQNSVSPEVAVEKKSGSISDNGKTNEENASKPQVKQTSTHYTPKLITSLDCKILQYQYNIYKLEKSISHIRKLQTECQGSPNLPLLHYIVLLVGCTFSINDKAFDPKLDILSNFQLFRSTTINITATTSHIPYDTPDLPITPLNDIPEISTSIKCLKQLESLCNTCLQGYKKKLDQAKVEKSNELGNVDSIDAYYSTIEKIVSN

SEQ ID NO: 22696 - protein, 75 aa, Candida albicans
AIDVGGCGSGGDTVLVRLLPKFVDVSVLLTDLSDMTTKGEQKLGINRALKKLDNGLYTFFSVRFFVKWLSLLIVD

SEQ ID NO: 22697 - protein, 64 aa, Candida albicans
TLELSITRGKSTTITIAFLINEYVISFKICIYGGGGEPANEGIPINKQIIETINFCNPIYLNGC

SEQ ID NO: 22698 - protein, 72 aa, Candida albicans
IEVIIQSNLVLALWIARESKIFLVMFFFSVSVSVSISVFHQIRITQVVYLLPIRYKSKIKLVAELNTRVINN

SEQ ID NO: 22699 - protein, 91 aa, Candida albicans
KFQKGKEKEKIVVKYFWSIKLLKVLWNRGLLVFVVFFVQWLGELNNLARDTRENLQEIPQFTKLHSLTLWIVVNYYKVLYVNFNLNYIKEP

SEQ ID NO: 22700 - protein, 63 aa, Candida albicans
KKMSDAVLEDTIYDDAVSFTTKPYDSVYPKIDSSIVNLPVTLQRLPRNNSMSDNRLVSTLNFN

SEQ ID NO: 22701 - protein, 98 aa, Candida albicans
ITDYFDYFMSDNYLLPFDSLLPIEILYQIIQYVGIENLIQLLPIPVSPYLQSSFIHHNPNIKRAIDNLIVDSNITFNNRLVQHSLIHRYLRTRSCLHH

SEQ ID NO: 22702 - protein, 63 aa, Candida albicans
EDKQGRVRLGIDQRTKSRTSGQVNWPANERQWIDTSETHGWLAGGVNRGQANNLQHSGRRTKI

SEQ ID NO: 22703 - protein, 75 aa, Candida albicans
PEYCDISSSLMAIWKSRIMKYIYGKIEVNANGSANRIIQIIIICRIGKSFNDSLYDDGRTIACTGVIEEKERCIF

SEQ ID NO: 22704 - protein, 60 aa, Candida albicans
  UNSURE (40): Identity of amino acid sequences at the above locations are unknown.
PDMHKISLFLFGSVNMDDAEKKEPPFFGRTKVVSVNEPKXKTKDPYLSYLISFKILLIHT

SEQ ID NO: 22705 - protein, 78 aa, Candida albicans
NLNKLELDKEKRVEIEEVTESNATEVDKQWLFYEYLGLLKSYYRKYIIGDVECHDKVKEIVGQLENALAKDEILKWFG

SEQ ID NO: 22706 - protein, 63 aa, Candida albicans
FDLGNIRCSLSILQHLNLLSRKSDDENIFLSENFSLSTTSAQQKIFHLVSGKISLEDLPYSEQ

SEQ ID NO: 22707 - protein, 201 aa, Candida albicans
  UNSURE (132),(147),(167),(178): Identity of amino acid sequences at the above locations are unknown.
WIRVQIYHYQPQDVEYCYDPEPLAIPCQMWPVSHVGLNDDGSMVVLVSTRQGVIQGYDKRELKWTLSVHFRGKVLESFFRRRTVPGFLARKMIRKKRGSDASMSSVNSLINANFPPPIQMKSFGQKQRERTXREEFVMVMDSGEILXVSCNDGKVQSYDVKQQLVCXIKNRTPRVMDXIVVQTKELDIIVGKHVNNSMKKQ

SEQ ID NO: 22708 - protein, 74 aa, Candida albicans
IKYNPRNRTSIASSESNGKMLLLVVEPPILFNKVSNEVTHNDSSDFISALGRLFDLLGDNGLDDDCDDMNANSF

SEQ ID NO: 22709 - protein, 70 aa, Candida albicans
LHPLHFVLQFPLPLGSHFPPPLTTQTTSCSIVPSPTSKHDEIHVWAFTIDSTHHFASAMHLHHAAGRTTY

SEQ ID NO: 22710 - protein, 552 aa, Candida albicans
  UNSURE (177),(178),(503),(509),(512),(547): Identity of amino acid sequences at the above locations are unknown.
SIISQKIDLQDIPLMLDDGSGTENGDKKTKRRYRVDRDNIKINKRIMSQDTEDVIKMFKKFDDEVLTNPEARSRLLSLGFETRKRYITTFKHYIRFCCKKKLDKFFVTGELMKEFYQEQFAMSSSNKPVIRLRKMDPAFSKLQEINFLVYHLANKDIPNRHLALEYLVYKEMGQDLXXNGSSDGKINTFNESAPVAAPAPAPAPGSLPGSVPVSKTGPIAGPESVPTRTRAPVLPPIENLDSGQRPSTRSSSNKKTAEQKEQELTPLTRNSANKRGRKSLKLKLNLQLSTSGTDMGETSLSDSNALKMINMQSRYVPPLPQQQQQQPQQPPQKVLSQRALPPTHSLVSSSVPSSITTSNDNKSGDSTPVYTKKVTKKNIEAIRKSFSKMRQDIQEALHRDVSVDPAFVSKLADNINASLDDFELQLNGPSPPPPQMNSNGIPIIDLNNKIYTVYDILEEWYKIEPSIATRLEKWGEGWIRDSIDHNTFLERKLVVEFVERMSXECNVDXYVXANDCDRYIRDKSILEKIYAERELDVDELCERILRXGTRQR

SEQ ID NO: 22711 - protein, 83 aa, Candida albicans
RLVLSLQNQNYTPAKHNQDVNREGVVICLTIFYFYYILGAPKKFRLYELQHHLLKSKKNHQSPTEMILLALLARLIAAKSAIE

SEQ ID NO: 22712 - protein, 66 aa, Candida albicans
FILIKYFELISIDLEEEEDVESLVVADFLTNILIGILKLSAILTNVTCGGILICCSSLNVNLSEFV

SEQ ID NO: 22713 - protein, 65 aa, Candida albicans
KKKRTHQVQVQVQLSNKNQPLYYPQMSSIILRFRSKDGMFRITTDSSSNFTFMLEQLIEKLSQSR

SEQ ID NO: 22714 - protein, 99 aa, Candida albicans
  UNSURE (30): Identity of amino acid sequences at the above locations are unknown.
KRVLTITSKTHTSNQNNKNNEHEIYLESEXKDAFWNYPSPLSFHDSPLQIDIDSSSSSSTSPSSSSSLISSSGPTNHSIADLAAISLASRANRIISVGL

SEQ ID NO: 22715 - protein, 221 aa, Candida albicans
TNSDRFTLRELQHINMPPQVTFVKIADNLSIPIKIFVKKSATTKLSTSSSSSKSIEINSKYLININYQPYHIQLSKNQLNSIINKLKPKILPILIYNNHDQPITNIETQQLIINDEEDTLKIIIPQQTILNVRARLRLINYENFITNSGSGNGNVSELEITSLWKKIGNSEHNNNLKMLTVKKDFKFPKDSEKEDTKDVKFKLKQNYIIDNLKDCIKVYIN

SEQ ID NO: 22716 - protein, 98 aa, Candida albicans
THSFFFLVATINYFWHFTVAYRYTSTMAEKLELPLHSKGASSSRKKVYSLFIGINFILILCTLFSYGSDKSKPIKTPIDVFRTFMQEPHEPNSLCPIV

SEQ ID NO: 22717 - protein, 64 aa, Candida albicans
LGVIENCRNRQTKKHPKHNVFLQCTTQKFQTNESQQLNDLEIVKQSEVIRFELTNYILVLLKSN

SEQ ID NO: 22718 - protein, 77 aa, Candida albicans
PNQVKSAIQDDPLLKIKQQQQQAQRVARKQHPSDKHSHRFRHSSKSSSDRVHKSHEHERSRKHNSSHTRHKDGSPHR

SEQ ID NO: 22719 - protein, 83 aa, Candida albicans
LSNFTCKSRIYLSANFSLNSLCSCCIVCARCNNDGDNVGIVNDDPVDELNRGKFGILLGSIGRILPQDDKPKRGGILSNKCMW

SEQ ID NO: 22720 - protein, 150 aa, Candida albicans
FFNIFTHLHIYIRLAPYHMHLLLRIPPRFGLSSWGSIRPILPRRIPNFPRFNSSTGSSLTIPTLSPSLLQRAQTIQQEHKELSEKLADKYIRDLQVKFDNYTNILSMFDKLETFTQEYIELTEITDDRDLYKVAQEELKFSPRDWTDPRL

SEQ ID NO: 22721 - protein, 79 aa, Candida albicans
QHNANGRRKKNNNSMKIRINNIEQQLYNFGVESLTSIPTKNQQSWPFNFYFSYLDKVKPDYQNGIKRSCKRRNPRLYEN

SEQ ID NO: 22722 - protein, 109 aa, Candida albicans
FSYLLPIHKQIMFQQLTYRLRLFRRRHKYIFINSIFLLVIIIFLIYSYWSNLPAEDNSAIINEKGTYHRSLWESITMALFPPKTKPFEEKKPQVHPNNNQVFTRRGRTH

SEQ ID NO: 22723 - protein, 67 aa, Candida albicans
DYASTMTNIPNEKLDCMLCEKKDANKYKIELALASEASEKELNELKLNLERIKKQRILISVFSIFLY

SEQ ID NO: 22724 - protein, 61 aa, Candida albicans
PSNSEHQERSAESDLQPRRVRQKRTRISEDGQIITNNRKLVVDSEGAMERLSISPQRQIGQ

SEQ ID NO: 22725 - protein, 75 aa, Candida albicans
RAYTKKFENLCLFFFFVNWVYKVGISLTVVKDGTCISNEIYTPCKTETMNTLVQDTTEVIRRRVSNARLSVLEYM

SEQ ID NO: 22726 - protein, 73 aa, Candida albicans
  UNSURE (1): Identity of amino acid sequences at the above locations are unknown.
XALLVVTALISNLYHFRYNYIHDFKKTEGGFGRKTKKKNRERAGVKISQTPIGGSLPTPKKFKEKKNFASQIL

SEQ ID NO: 22727 - protein, 73 aa, Candida albicans
KQTGKVRPSSRATVLGSFKPEAPPAPIPNAASAPAPAPAPTITYLSASKVSTPIDPTNNQVQIATKPILARQS

SEQ ID NO: 22728 - protein, 271 aa, Candida albicans
RVILVFIFCYYYFYFYFFIFFGHPNQHQPKIMIPPTTNKNKFKQKWTKIKLRFRKNKTHEVDDQVSIVVRSSYDSCVKCMGEKLPLDELTDISTQIHPQQTSPFKEKMILETAKHIENKQEKLDQAVELLCSVVSSPRHPQPQYQMQPQPQPQLQHQQLPTYPPPKYQPRSIPPTIKYKSQLNQYLLDKASDPKPYTSISSYYMNLHNSFANYYLIVQDGSYQCVNYKLLEPEIEDSSRLLKSHYRFFYGFFVLYISIFVIYIYVVTTQAL

SEQ ID NO: 22729 - protein, 94 aa, Candida albicans
FELNQTRPYGLKEGKEEEEDNLHISYIRMKSPIEYIHRLIIVFFFFLIYLIRFLFWFGNLFSSVTICGLSLFCLFILFLFLLVFCYIDQSTTAF

SEQ ID NO: 22730 - protein, 144 aa, Candida albicans
EHFMRLHRSHISDQLLEDTFDRVADIEALGRTRELVLKDLQLGSHYEMLKKKHPEGENFKFFMIKSPKQNDLHGDFDKYNTEEINQADDDDEDEDDLYLEEINRKDCRKWWKKRMQKYDRLFLPDDNKHSEEGDLDINRPREDE

SEQ ID NO: 22731 - protein, 82 aa, Candida albicans
FLSGQSASHRGERKDFDCISDLSDDQLWNHVKECNCINPFGLLDTNTLKTGVIKAGKANINIQASGSFSFGNTDSTLTTTSS

SEQ ID NO: 22732 - protein, 67 aa, Candida albicans
ESGHKNSFNFSNKKKLHRACCWIWLEPKKKDYLTPKMEFENGGDELSFVFYTFPIQLCRKTSISNTV

SEQ ID NO: 22733 - protein, 71 aa, Candida albicans
GKKKNERKSDRDKKKIFFHSKLNKGQSNQFIAKLITRKKKRREEAKKKKKIFSYIEKLLRTRPGFVYFIIL

SEQ ID NO: 22734 - protein, 82 aa, Candida albicans
TFPSYCSYRLSLVLYKFIFIMHSFYTRPSAFHSKSSTALLLGYLAISTTVPFFLSYKETNSNAIGNQLLKGTISARSLFTKL

SEQ ID NO: 22735 - protein, 64 aa, Candida albicans
LKGGSDLTSALPHLKDFFFMQVLLYFNNMFEKYNQFLINIRQFFTPKKKQRAKYICVLLKQFSN

SEQ ID NO: 22736 - protein, 191 aa, Candida albicans
YYLPPAMIARQSYRKLFRNISITRAFSNSHLRILETKKEPQANSSSSTPPHTDDLYFGKFTKEEYEDAKKIIQEQISKLEGQIKGDYNVRENLGKFSQFPEPASQDSKPVKVENLSDFFRQTIKLTGPIPLSTYMRQCLTHPEFGYYTTRDPLNLRTGDFITVSRDFLCVWRDDWNLVFQYLATAKISRIN

SEQ ID NO: 22737 - protein, 82 aa, Candida albicans
SYIDDDYTFFYTHIFLIGYFISFCLALLLCSGFVIFGLFLTFNIAFWDESLVVTNCYLSFVYRESLWLSRVFSYTFFVIDFR

SEQ ID NO: 22738 - protein, 63 aa, Candida albicans
HNNPRIRFYWARPLEVLVNEDNSKWRTTAMTKEDSEEYDSTDDEDESEFEDEYTGNEDGLFAY

SEQ ID NO: 22739 - protein, 71 aa, Candida albicans
QNTSSENLLTYDAGYKKILFNKVKKKKISHKTNKTKEQNRTERSISNKCHHIHYITIGKPLIIRINRYLQY

SEQ ID NO: 22740 - protein, 67 aa, Candida albicans
VNNLKIIIRRQNFFLRQRNMVGWGGLLKFTNYYNLLYPKKKERKKERKEKYENKKKKSGYKIIRYFL

SEQ ID NO: 22741 - protein, 67 aa, Candida albicans
VNNKSIIIQVLETLLNGKSFKPRMGSTVQCNAPRRRSLNEKYESRIYLLMMMILSNSRLCFDKRLAR

SEQ ID NO: 22742 - protein, 99 aa, Candida albicans
TIKTPQDYNTIQYITIQYNTITKKDQIRQLNPIITSSLIVHLCIMYTPGTYTYDNNTHLCVTKFITVYCGIQAFKHSGIQAFKRSDIQFNLSSQFCNLG

SEQ ID NO: 22743 - protein, 73 aa, Candida albicans
FHKVFMVCHFMRMSTSKKKNSTKFSHTLKFILTYHPPYSLLDYINESTYYIHSKIDNMVLIKICFILVLYIKY

SEQ ID NO: 22744 - protein, 254 aa, Candida albicans
  UNSURE (248): Identity of amino acid sequences at the above locations are unknown.
TNQHIYKYFTPPPSSTTFIMSSNQTPTTDNVLLTLKEARKLALNEPQNYPNVLRSMFNLITKEPETQQQTSEIQQLIVDFMYETFINNSILQQSVKIELAIDSLDALTILTNIHDIATLRKVIDISCVIYRLLFQYVALNDNSNQIWSKITELKNVLVNKFQSNFPLPPSDNTEHDLLRNIATKLDLLKFMMTIIDVSSKTRIIGDPIQNTNSMQFSLNDVPPNHSLIKYDQMEYESQVIFKSMVIKXVFSKFK

SEQ ID NO: 22745 - protein, 61 aa, Candida albicans
RNQEVREIKKKAKKTKKNKNLGVARMIMEYICIFKVLIYCVKKSKSTSKIILNKNNNLRDD

SEQ ID NO: 22746 - protein, 94 aa, Candida albicans
YNNIRSDSSTGKMIHQLKVGVENSGNNGSNGDGGNDASVVVVLLTRTNRHHPLPSSQSSTNSNQLNSSQTAPGAANYLSSVSVGTLMILVLGLI

SEQ ID NO: 22747 - protein, 74 aa, Candida albicans
TSKKGLTRQLLLEKPILPPPPTLIIWKKLNKNDDKLNQKLVQVAVSLENKNRIHLESVFTLQNLHIILKYLHTF

SEQ ID NO: 22748 - protein, 239 aa, Candida albicans
IQNFQQMKFIILLFALIQITVAANRALIIDYLYYGCNLNCYIALNQENTCGAHDNDVSDQQYHACLCMNYDYFTNLMNCNCFDSNVYYVSSSICSMATASSEFETYDGAPSTMNVSTTDYSSSTEDISFTEDVSFTEDVSFTEYSSFTEYSSFTKYSSFTKYSSSVSSFTKVIWSTLETSSIKGIAATTSSYFTNAQTTSGTANDSSISKPSGSQIFVLCVISVVGFIFFFLFFLSLFV

SEQ ID NO: 22749 - protein, 64 aa, Candida albicans
DNYFFLPLGGVGSFFLFASKKNFFFFLNSNPNPTQIIKKKKHEVNLNSVSFYFYFSPQTPIGFT

SEQ ID NO: 22750 - protein, 63 aa, Candida albicans
ERKKNFSWMRKEKRNPPPPTARKNNYPILLERRKEGGREGGACFPFLWLWSLTVEGGIDQEIH

SEQ ID NO: 22751 - protein, 60 aa, Candida albicans
NGYQNHHQQKKNERNYPPLTTNSIQFTTYKGKSYSIGSLKEINMVKREAAVVVVGGSVGR

SEQ ID NO: 22752 - protein, 77 aa, Candida albicans
DELYKFTRLTHRFFFFFLAIFHTQGRQTSNIKLIVLHPIANTSFKNFKSIAEDLYPNQRIRREVKGSKYYNNGFNYK

SEQ ID NO: 22753 - protein, 68 aa, Candida albicans; identical to SEQ ID NO: 21149

SEQ ID NO: 22754 - protein, 73 aa, Candida albicans
NIIIFLPPKTTINLFMQDSSANIISPICGKKLIIKGYKSNITKHKFCYYFNPNKTQYNAKKNEDKIILQPALG

SEQ ID NO: 22755 - protein, 64 aa, Candida albicans
RSSRSKKEHKLTQNYKMQNLIRILRSYNSSFIFNYIIVLKVYFSSHIWNVNKQIIGCSAQRVSP

SEQ ID NO: 22756 - protein, 141 aa, Candida albicans
KKIAIQIISMTNRNENTDVNVDFCLKLSKLPPEVLVVILGYLPKCVLPELLYFPPIREVVAFTILSNVNITYSMERQRWKGEPCPGYIERNYHRFDIKLNNLKKGISQWNIYPKSIHMDGSDQLEQVLETFPRTFNQSSGY

SEQ ID NO: 22757 - protein, 66 aa, Candida albicans
SVVRDESDDLVDEEISVPLDVLTVELKVSLVENGVSVNLLGLINARAEYFVNNWASVKSRGQILTK

SEQ ID NO: 22758 - protein, 64 aa, Candida albicans
SITKTGFHLKFLKKYIFLVMHKPSINQNLTIMLLQGMDILIKFYLSSPRLLSKLKFLFLSTLLA

SEQ ID NO: 22759 - protein, 75 aa, Candida albicans
KERGNKVSREEWIQQNEVNKTVKTMRIWKCRKTKKFLPLDNTRMPDFHENKVCNYLMRCDGWLVGWCEFLFFFLG

SEQ ID NO: 22760 - protein, 77 aa, Candida albicans
  UNSURE (47): Identity of amino acid sequences at the above locations are unknown.
PTNQPTNYPLNEFETKQRMVRKIDFIHAHYHNNLQFRDKKKKKVINXYRRRSSHLLVFLSFLISNDDYKMLCPSVPI

SEQ ID NO: 22761 - protein, 297 aa, Candida albicans
SFSTQTFFILFFNSYFSTMKEFQFDPESFSKVTYNIGGISTYIYNSDKLASYVEKFNKFDHPIEAIPINVIYLIHHRGGSHKHTEAIAYNYLKQFYDKKSQDYDIPLICVTFDNPNHGQRLVNEHSNSDWAENNETHGADMMSIIEGTIQNIRLIMDYLPSYLNLDSYLSDKFKRINPGTEIKFHNILTGYSLGGHVVIRYGIDYPHDVKIIGPVVGCSDLTSLLVTRLKSITNNDKKYFYFNYDELDLTDEQKKQYPETLHKRISKQDQAIFENYPMNNLKMFASFESPPRPENRV

SEQ ID NO: 22762 - protein, 63 aa, Candida albicans
CWPGACRDRDFLRIQSHINSFEQFRKPVINGIQNATFCDLLAMWDLIYSNGFMMLVDTTNVGY

SEQ ID NO: 22763 - protein, 62 aa, Candida albicans
ILYYSFCFLQNQNLQINLLHLAGKKKENKKSDQKTLIPFYEGGFLQHKILITYSITTIFMKI

SEQ ID NO: 22764 - protein, 74 aa, Candida albicans
KQGSTAFCRTKKAVFAIVKEFAVMSVEDCAMKNNATKIKLVPIYTFFSMSANHARTVRNEIQLLSVEQKSPFWP

SEQ ID NO: 22765 - protein, 67 aa, Candida albicans
RVCVCLSNHARIIKSEKVITEEEGEREEKKKCTQSENKSSIQLFLLPIVYYQPPLSNRYFLHRISPN

SEQ ID NO: 22766 - protein, 61 aa, Candida albicans
IVFGVCFSKKILYVIFTIIEFTSSQVSVQEISSVYKTYSLISLSSCKDLKLLKTTFIYKKN

SEQ ID NO: 22767 - protein, 62 aa, Candida albicans
DSKFSNEMISSLNALLFQHKRIMQIEDLIFNDHTNDIKKNNVYIPVEVEVEISHECYINKIN

SEQ ID NO: 22768 - protein, 97 aa, Candida albicans
SILTNFIMSENLKRAESLFNRIMNQTTNNDSSTSSFASQSSTSTTPILESSPTTSNNTTANTYNSRPNIFGSSKFNSFSKFGFLLFHLIFPNWILKN

SEQ ID NO: 22769 - protein, 84 aa, Candida albicans
PFIRGLTALVLFEAATKPKNTKPGKLYKYYQEKLSCMIFNYFFITFFLSFFLSYWCCSNILCNCIYHSFINLTYKQYIVWNYPI

SEQ ID NO: 22770 - protein, 68 aa, Candida albicans
RGGSPAVVKIQNNIVDKFNVWPTHTILTILQKCKRQMKAALSQTKLVREYVIPHDYVHISHSLSRIKT

SEQ ID NO: 22771 - protein, 247 aa, Candida albicans
IASFRVHLLSSLFFIIIKMPSLERDTLLAESKTILKSVTNWKPGKQFKSNVIPETITTSTYSTTNIRDNQFWCARESLIPSAYKQKVIDCLIGTANIGSTHSDHEVNYVEEFDSLKISNVTEYPDGGWSYELHANYKFGTIGISNRMFYESVHIYKFDKSNQTEEDDKDTNCAYIISVPIDGPTGNFVIGKYHSIEKISWSDNKDSDLKWIMATTSDAGGYLPRWLTNMILPGAISNDVPSVLKYIQ

SEQ ID NO: 22772 - protein, 206 aa, Candida albicans
VASADLPSRLVQDEQIESVAMGGSMLQTSVNSIRSLYVPNDIDQDFFYITCNPKQRNFQSSLPYLPHLSNMNSDTLTKYQLTALYYLHDQLSNIFQPTFFENQLHEFFHKFTSNKLNDWMFYYIKYQDKYIIIMKNKSKNTTSVLTNNQLSASVPPTIERSIVNRISEGVLDYTKLGFLENLGDDVKYWLGTQQEDLESIEQVSLL

SEQ ID NO: 22773 - protein, 86 aa, Candida albicans
FIYMSFTLSNELNKKKKIQSILILSNILTSITVSFSRSFFYNSLVCQIVSTVHSFFNYCSFILIINEIFTSYCFSLCSFIVSCSSF

SEQ ID NO: 22774 - protein, 81 aa, Candida albicans
FEPTLFAPRGNTPFPEPPEEYGHDCPAEAEAAATVIPEAAEETLGLTMPTVLELEPEPEPEPEPEPESEPEPAAIVLPAFE

SEQ ID NO: 22775 - protein, 73 aa, Candida albicans
LKLHLKLCNFFLDVLADIFPETADDEDEDDEFPLDPLDPKDEANSSNLFKKVRLVVMGVDLIPLVLLVLVLDF

SEQ ID NO: 22776 - protein, 82 aa, Candida albicans
EVLDLNPGLVLNKKPHNCLPMINNNDQKKENEKEKENENNRFTFLLICFKLSDMKQRLETIAIDSNNRAYNNDDVLLFGTNE

SEQ ID NO: 22777 - protein, 71 aa, Candida albicans
CKNQTNNERFFPRYSLFYCVIISTLLTNSMTIYQTIIKFVPTQLNNNNKHTISRHNFVKEVKVNNNKNYTQ

SEQ ID NO: 22778 - protein, 259 aa, Candida albicans
RHAFCHARSDVQEMRYAKIWTNSHFNSSVKKWILRCRVLHSRICSFIHELENYIVHDVIEHNFEEIKNLIHTTATNLATSELGSDINDEGDNIFNGSLIRGTFNNNSIFDSKVHKHRTTTYVEGISTVEQLIQKFLDYSSTLLNDSLLTREESLRQLRKMLDFIFHFNNYIVQVKKVLVLLNHELFNEYSKEFPTKFEKPMDQELIDKRFANLSDTFLMQYEKFGENLVTFLATIKQVGERENQGLLELSNRLELCFPE

SEQ ID NO: 22779 - protein, 67 aa, Candida albicans
LQLLKIRNEGNLTKQSKTAKKTEKCLSFLTFWIYKVSFFSFLPFSFSLLYNYPRLIRLEVGIYDWLN

SEQ ID NO: 22780 - protein, 68 aa, Candida albicans
KYKPETAKKKEERKTGGVLSSMYETALIFLFHLFIQPYIHTYIHTWKKKTRRPPQFQIDLNKRSIKKS

SEQ ID NO: 22781 - protein, 84 aa, Candida albicans
  UNSURE (49),(55): Identity of amino acid sequences at the above locations are unknown.
DQSKKINALSKKKRKKINPTDPLVVSYYYGENYVGPEKKKRVPTEEKKXTVCFFXRGVWGWATITKTTTTRGTIKKIQHPGELN

SEQ ID NO: 22782 - protein, 84 aa, Candida albicans
KILYRDRICMNKQMYLYMLFLKSYLANPFFFTTAFPHVNLHKQWACSLQTIKATLRQKKKNFFLRLNSTYIFAEHHLKRLLIKV

SEQ ID NO: 22783 - protein, 61 aa, Candida albicans
KPKKKRIPTEVKVERNKICTRDLSIFILSKRRISIIFLFNITHHIETTTTTTKRVRSQILK

SEQ ID NO: 22784 - protein, 335 aa, Candida albicans
  UNSURE (318): Identity of amino acid sequences at the above locations are unknown.
MDQQVWNPIFSPSGTTPGKSPSYYNELAPQSQSHISNQDPQLPLQTQHHQLFHIDGGSNHSTPSGNIQLPSSSQQNTPHIVSNTPTAFADSDQVFLQHMEMYDNQQHTNQSAGNTPGPISFHNHNPNLQQASQQPHQHISPHLNNLQQHSQQPYQHQHSHSRSHIDSEAPSANDTPTSSGALGMAPQPPLLSSTTNPQSFDLGLDTIGFIIPEELNFDTDPNHISSAFPPQLPADQTPSLLAVDKLKQLQQQQQQQQRQQDPLSELSSPVLPGQNDQSYNPHHYYHRQSSSNSVFVAGKNTGSSVSAPSQHVRTDAVXTPLSFARRCPFRYKWQG

SEQ ID NO: 22785 - protein, 132 aa, Candida albicans
  UNSURE (6),(77),(85): Identity of amino acid sequences at the above locations are unknown.
ELMLSXPPLVSPVVAPLDTNGKADKENGNNSGGHNNLHNSSFSPQPAVQISFEPLTFPALNAEPSTIKSKGGKKNHXETDERRRXTSSAYAPSLDEKQPYPRLNPLGSQFCKVIQTMLTPSNGYWLTIQITN

SEQ ID NO: 22786 - protein, 343 aa, Candida albicans
TRIFTRGGHDVPVAEMIQVIGRARNKVSHMVELYSNRDPDEVRCFRQQMAAFYGIRAACNNCCGVVDAEHEDMLRKLWEDEPEETNQYDEIVVVAETEEEKNWYDEIVDEAESIMQQIEMGNPVIGSTFKYCKMAKYIQMFKSQPTFEHVDMCGYCYMPVAYCTRGRHGCRYQKTVKNVMMVRWILGDIDVEGIKEIIGGVEGVEQINWIRENEEYASAGIREYCQRMVSHSFINVDELPRGMPTTQLMFLMVVEQWKDTSVFGEGEEDQAVARNADGYFASNWRNEVEYMTFKMEDRCQWCGVGVGRHQCCGRFIPKLLYAIFVDHRMPGYVGDLRIFEPWF

SEQ ID NO: 22787 - protein, 78 aa, Candida albicans
WQFTKSTTKVNPVFVPQFIATQNPCSIENLNYTALVAFSILILPLYFQGLGRFSISIELLLVELTAIPYCKIPILPMN

SEQ ID NO: 22788 - protein, 77 aa, Candida albicans
FIFDQVKCLITGGIHNINTDNNIQKIDKPFIIQPIFPNLNAAPRTFFRLLIIKHNIGTPLANANDMTAAPINALKAD

SEQ ID NO: 22789 - protein, 175 aa, Candida albicans
IVYNRVFFFLLIPPYPSNTFRRTPPLPHDMEKDNPLLPFAYTNSSINDSIPYDTTPRDKSTIDENASSKYHTRKTVLSASSPLKPQLRRVALSEQRFLPSLKRKMGESFNDKDNIKRVDLEDFYDDSNEEGETPTVINIDIDNDNEQGENDKYQLPPSSPPPPLYFSPRPRQGPS

SEQ ID NO: 22790 - protein, 80 aa, Candida albicans
PPPQQVTNNGNIFCGKTICHTPRVKNRETTIVIGACNNVQFVERVCGCVFVDNLENYFITFTTKPRQSHSYIQRLNFRQS

SEQ ID NO: 22791 - protein, 76 aa, Candida albicans
SNWSEIYLSKENFFFFSYPGGKVTRPLNFPTSSSSSSDDRMTISQFTIGYNLIINQPTTFYNYLIILKSHLMMMTK

SEQ ID NO: 22792 - protein, 73 aa, Candida albicans
RSCIFRHNSHILKIIHTSLKCVNIPNIINYMCSELVAKLSTQFTLYKPYNFSTFLYFFILAFLLESINTFFII

SEQ ID NO: 22793 - protein, 62 aa, Candida albicans
PKYIPFFPSFFISIFTYCFFQIRISDSLLQDTNTYLFIQHSHTHPPTSFILSSPRGWKDPRL

SEQ ID NO: 22794 - protein, 141 aa, Candida albicans
NRGFMCKIKNFQMLEKWFNHVLKRIPSRILGQRFAPIKSEKEAALYFRKLIKNSMEVSTLKVMMNSKDLPMVFLTSGGVNSVCLSIVIIDIGLCYPLVFLAATFVTTKKNQVVGMDGEIPQVTKLPEITSICTYTFENNGQ

SEQ ID NO: 22795 - protein, 107 aa, Candida albicans
ALNIPLLTEAIPSKICKTLTKGFNKSTMSEITSGSSEKIRAISYRNENNAKQFMVETITAATMATLVAKIAPTIFCPPIKLAILVVAAIPTENGTIYVSDAILETAL

SEQ ID NO: 22796 - protein, 64 aa, Candida albicans
EMTEHVKFSSLTEIKSTRDIVPWMMMAQQTTVDTFNPLIAIHISFTNRVVNIAINHQLTKLALV

SEQ ID NO: 22797 - protein, 122 aa, Candida albicans
FYFCETGKFDMLCHFSSLHYPHTSMPTQRTSRPATHEQISKSRVVNASILTFLTVLIFLILLYHFIWAVQVMMYQPYGNLLNNIVYGPGTLIANAGLSSKLIKYINTKLVEDKIEADYKKYI

SEQ ID NO: 22798 - protein, 162 aa, Candida albicans
  UNSURE (1),(15),(34),(36): Identity of amino acid sequences at the above locations are unknown.
XIKPKFYVSDYACSXGRDFKAQLSTVVLFKIIKXNXLKLKNWDKIVEIIEKLYQYSLIIDEKDTTTTTTTNDNKEGDDEKDNKEATVETDNSILKLLPSKDIKKFPIKRITNDLFLSILKNLIDNQPTEEEIQSTLAAMDCIKSLDILNVLRIVAESKKQAN

SEQ ID NO: 22799 - protein, 80 aa, Candida albicans
RSCIFRHNSHILKIMHTSLKCINIPNIINYMCSELVAKLSTQFTLYKPYKFSTFLYFFYIGFSFRINQYFFYHLDTSFIY

SEQ ID NO: 22800 - protein, 71 aa, Candida albicans
IIFSIYQNTTQSRAKKDIRRNFNPKKTKNYQFNSFYINSFETIASQQFTNNLILTILFCTERDAENMNPDE

SEQ ID NO: 22801 - protein, 66 aa, Candida albicans
PHLVLSFSSKVGCATWPIINNKLALHNGSDCTEENNTLIYSIDDGISGLIIHMDNSVHSERNFLFI

SEQ ID NO: 22802 - protein, 154 aa, Candida albicans
QTNKLHLMKIMINLLIHLVICPTLILLIIIMATNLIQEIIPINIKTNGVDYYNANNYHNNQTPNHNHNPNHNHSHSHSHSSSNVPQYDGNNYNNHLTNHLPESVTSSTNLSTSSSNFSNLTYHQDPNKNNLTDSLDVFMYNVELSDILYDVKPN

SEQ ID NO: 22803 - protein, 157 aa, Candida albicans
NLGSSTRGEDLNHRYSMVLRLLERLETFLKLRYQTSAGGGGGGVNNNNNNALSIKLEQEFTNLYLYNGNVLSSDHNTNTNTTNTITTTTITDNGTKQNQHHSQDFGLEKTLYILKMGENVLNYIYDLNLKVCVFKKLGDSLSEIRKYLIDNESTLNG

SEQ ID NO: 22804 - protein, 63 aa, Candida albicans
  UNSURE (54): Identity of amino acid sequences at the above locations are unknown.
RTKYQITNSRKNSSVFVFHLKLLCQKRCPPSLTTLSKSYQFDSNFFNAIICIFXHEPPGPHKV

SEQ ID NO: 22805 - protein, 158 aa, Candida albicans
KQQSQIVQPDSNNNNSSSSRKEPQALQGVPQGPQPPPPPFQQQQHHQQFQQPMYSQFPPQQIPPNQLPPWMRGGPLPPHLQGKGFPPPPPPPGFINKQPPQNQNQNQSQGQNSNQNSDQQQQQLQQQRLPPPGIFPPGYMPGPPTGSNFMPPPLSQQQ

SEQ ID NO: 22806 - protein, 70 aa, Candida albicans
FFYFLAKVKYTKCLRIVFFLTNYKYTVFNYFIYLFIYLYYTIDSKAPTALHGHAPTFYKTCDICNKTFNN

SEQ ID NO: 22807 - protein, 61 aa, Candida albicans
PEIQLMHTYVYAVYKIVHNKIIFVVIIYYFSGYAFIFLFCSTIIIIAQTYVSAILDDIISS

SEQ ID NO: 22808 - protein, 197 aa, Candida albicans
SCRINQIRKELRNNTLTLTIVILCFFTVWLAKLTEQYFYCNNCSIIFMNTTNESTNYTTINASSVNWSNNQINSSFSSLRVQINDYDTYQTLPTRLDQLCTQVTQVPIIRIYGSLSVQNSLSNTDSPNKKKRKIDETTSPAVFNVVIHVHNFYPYIYVDCHETDFTKLENDDFIKLITDYLETVLEDVFTTAWASKS

SEQ ID NO: 22809 - protein, 296 aa, Candida albicans
TKTTSSNSQVESNNKQMKTPERKTIKQSIRIEETKLSGAREGGGKLTATTTTSSSPTVTSSPNVTTSKFFTPKAKPIEKIQPENPTTEENLNKPDWDSSLIDDSEITDYGHGHNHESSDKPVDTQNILDELTDNDNDHEVEEPQQETDSNAIKIHPIVDVKQSPQSDNGFDICSNDDEIEESPIKNRVVAVGGGQEQVRTRLLALKESFLYQSTTKSTHQFTKPNNDRKRVPLQPKNINRIEQKSPTKSIKLNRKVDHHHQRYQDNNNVNILKVVSTVNSRTTIDIRQFAFKKQQT

SEQ ID NO: 22810 - protein, 66 aa, Candida albicans
IYQFNCLVFFFYLFILWQLVNVLESLSFSIFKMRVSSLNGGFSNYAGGKDSMPILTDYLRVLFCNL

SEQ ID NO: 22811 - protein, 127 aa, Candida albicans
RFYAIQKRKEIQKKKYVSVLKLTKLIFGESLTMVVYRVSKKFFFSLLYTLSYSVCHVHFIRALRVSCDVVFFSRILSQFTFVLTLFAISFVRIHSEWVKRITLVHLITCITYFNTVQSWQKELQMSK

SEQ ID NO: 22812 - protein, 200 aa, Candida albicans
HILADAIYGAFSCNVNKLEKHNAMKLVKIDTDCMGNQITAITAVRLKNYTYTIIGDALGNVNIIQTDSNDSMICRVHKFNIGDQINCIFALGRKKSWGAQICVVGTVLGGLFVLNNTDLNGCNDSLVEFAARNHLELLDCDGELVNNNEKSQCKEIVSDTVIARVLSHIIANSSEFSQTYSNLYLNRNLLQLVHFECNSL

SEQ ID NO: 22813 - protein, 66 aa, Candida albicans
  UNSURE (30): Identity of amino acid sequences at the above locations are unknown.
DWTSYLFEQGLAEGQPNFYKGEEEGKNTQXKDYFKIQSSEPNIIIVSIGLCTIQSAMISVKTGFST

SEQ ID NO: 22814 - protein, 191 aa, Candida albicans
MYIESSINDKYIRTLNFGCFPKNVLEFQQSQDYFQQLIFIDYQLQLLIDNEFFQNELLPISLLSENNVSANEKLQQLINYSNSISLNYENTPKSYDEKLYYATLMSHLYYLQDNFFEMSKYLNLVKVSYQARSNNQIETASSASSVSLNQIEFIEYLTTRYYVLFGLSAGNNGVNIWLEYLQNFKSPYNKS

SEQ ID NO: 22815 - protein, 106 aa, Candida albicans
YCIILLYLFQLIPYTKVKSCLICCTVWPSLSYPFDLMPSKPSSSVATLHKYSTLIPSVIIYIYYFEYLLENNFLLLVQIEVDLINHSSFKIGADKLTQDLQYITRC

SEQ ID NO: 22816 - protein, 99 aa, Candida albicans
KQLSSTCTNRSRFNKSLFFQNRCRQTHPRSTIHNKVLTNIYHIRFQFHHVFILISANLFTVPTNTFVYNSVRFYTLKITPRGIHASLIKAFTINLLIIC

SEQ ID NO: 22817 - protein, 92 aa, Candida albicans
RDEKEFTFLFSRTFRDFRNYIITSAQPHHDDKHTARRYEERTIKFYLNNTKTSRTNIPVVVVENQRSFNQQLKDYQQNNPVVNLGINFSSNL

SEQ ID NO: 22818 - protein, 286 aa, Candida albicans
QHTILNYKSQFQVHLNIYIIISKEMMLGILNQPKKILQLKIRENSTDLLSTSTSFSSRTTQGSTTAPSSSSIQQQQTSSLMSTNQNSFSTTTTSQFTSNSSPNSAQTFSSSPENSSSRMSTPTTSISTQPASTTSIQQSQSLQTSQQSQPSQQQSQQSQQSQSPTSTSQAPLSTMSDNNTSFVSPSDTSLLVSATTTSSSSTSSSSSSLTPSTSDVTTSSSASSSPSSTTSSSSSTAFSSSTTETSSSATSSSSTTSSSILSTQLNTSLSSNTSFSVVSHGAGETA

SEQ ID NO: 22819 - protein, 94 aa, Candida albicans
VDRILEDVVELELVADDEVSVVELENAVDELEDVVELGLLLALLLVVTSLVLGVRDDELDEVELEDVVVAETSKLVSLGETNEVLLSDIVDSGA

SEQ ID NO: 22820 - protein, 180 aa, Candida albicans
IADLPARRRNCNFNMNKVQKLRIVYEFSESFDMHAMLDVVEKFTSLESLNVNFDELGLVSFVENLKENTLKEIGVPESLDSFKTIYPALLHHRDSIKVIFENQDYFHANFVEWKIATEPNFDVDLDLDLNLDEFPKLEYVVRNGNIIFVDRNEPYPEFVSVEYHHPRKGYFESHPGWEFF

SEQ ID NO: 22821 - protein, 69 aa, Candida albicans
SVEKGFRSILVVISIGVSFLEVYHIVDVDRICNIKHQNKDISDFNIQIIMTNQQIYEWLKRIKITTKKG

SEQ ID NO: 22822 - protein, 70 aa, Candida albicans
NSLVYQNKYLKSEEWIHSYKYIIINTFKLSCNVLFSTSMIPSTKSFNRYCILTCAISMIPITGYRSQQLQ

SEQ ID NO: 22823 - protein, 487 aa, Candida albicans
KSSFNSHSLPFRFLFDKYIFHNFSLVPCFEEYLLFSENCLVTVILNMSSKGIDLELFGRLAKLPEDVIYIILDYIPKYIQKQLLQFVAIRKVVVSCYISNVEISDNDYSPFDLEESPFGPNPFEEFAFGSSPFDQYPVKIKLKNLKKAIQQWKIYPKKVYFSSLKDLITVHNSFPELLLKAHSINGVFDKHVNDSKTDDLSVLTRRNLTYGNLELRNYGIDFSTSKKKLPKKISSLTLMKTHINEFNFEGLKLLRAEINSEFNNTREVFFPPDLKVLELKMFGKKRLHIPSNLVCFNITGEDSKLDLVGGLMNKLVFLFISSHTLRSFNETGINAPNLTSLTLLECYSFTNFGIVKTFKHLKYLSMVGARFPVELFDGTSLPNLLNFLCNGEGAQFHVSEWDDMNEITHKINNLTIKFPPKLEDLALADLVVPRNVEYTFELPSSLKKLHFEKVPLNYSGFQLTKNLEEVSLELPEVIFNTPAKIHV

SEQ ID NO: 22824 - protein, 103 aa, Candida albicans
DLPGREEDTYWCNYFNNKKINVKQTAPKTTKDNGDVNANPQVGDIVKKDLLVKGQQTLNFPIANSASLKTPEGPVKKSVILNLVTTEDDRITKDGDDDVLMKD

SEQ ID NO: 22825 - protein, 60 aa, Candida albicans
LWFYIGITGILHIENTNYQNTKIVIAFALHQLQIIITCISLKLADANCFSDRFKIFIYKY

SEQ ID NO: 22826 - protein, 212 aa, Candida albicans
IKMSLTVRQPTEESYWNFKVNSQNNAISTMSIISQTDSLVVTNVNDDKLYSMDINDQFRVDRTIVTGVEIPDVSVVDTFEFNCIVAAKDVVSLIDLEIGEKNYEFYNTPKREERDMVRNAIIDCKFINNQLMATCGRNSRLNLFDIRINNNNGPVSDIAFVNYVIGGDQKCIGYNGDYISVGNSIGTIFSLKLRYLRIIEDKVSNSSIISIA

SEQ ID NO: 22827 - protein, 74 aa, Candida albicans
YSPVGSIESKKKKKKLVITLRYWLGERVSVCVIPFTVNTRNHNPIQDGLKKSEDNLSITKTVCIVFIFFFLGIF

SEQ ID NO: 22828 - protein, 191 aa, Candida albicans
EICSSSWGQLSDIDDISLLYITSHQLQNWLNHQKFFESLLKDKYEFKFNELVDNFLITNTNTNTNTNTNTNGNTNDKDSTKLTMGRIDLSIFEKIKTQPLKIETIIRPPTLIEPINVLGYNEPDQAWVHQDDFDRIGQNGQGQGQGQGHPFYCVYSSIGDPLKEGIRGLSINVEQSLQKKYKKLIEIWLQD

SEQ ID NO: 22829 - protein, 64 aa, Candida albicans
NTLQNNNILGKIQRNDQTLNNKYKNGRKKVNFSGGVKTIYRVYPALLNTQLLDNTDICHNGKSA

SEQ ID NO: 22830 - protein, 65 aa, Candida albicans
YLYLLKLVLVVSILLILVNPNCSDTTKCNNAQGKIKKFREFSDTKSREVKGKKKQGITQSNTFCV

SEQ ID NO: 22831 - protein, 107 aa, Candida albicans
LYLKTKKQTLYRMWETRNTVKKDNSKMFIGGSTFVFFEKTKKKKQQLPTKYHKTIVTIKKYYVVTQVRKTTWCKSVTFECQIDISFKHIHTHTERENERRKENWYKY

SEQ ID NO: 22832 - protein, 72 aa, Candida albicans
SMQLNINTIIDVWSLLELTKTNKINYIRQDHVTKYNLIIDYLLNNLGCKSGNRIQRQLLLLKLLKHIQLTLI

SEQ ID NO: 22833 - protein, 63 aa, Candida albicans
MWRRSLCFVASLRLKLPDCIFTSRRKKNKIQSKPHYVLVEKQGAPSEHKLSRVSLNTFLNAKS

SEQ ID NO: 22834 - protein, 356 aa, Candida albicans
PNFLLQTNKFHPLRLIFSFFFPIWPIKTTAKSLDMTLPANFKFKSTEDPKIIEQLYTLCGTEWGGKLTPEQFGSAQAKGNFKYVDEGGRILSYYIEDVNTGTIVATTSVKFCKAFYKPADRSSAISSIPDPSLFGVNNATALLISFVFTHKDYRKLGLAGQCVSKAIEATEKLIIKEKVDSSDESVADNFKKMSIADGTNETDLQLANYYLSKEYIWILYSGVNTYYERFGFKSFPMDFYEVPNTLLTNDVESAIENLIKESKEEKQLPSGKSIRLLLGDNPADQEIIQFILQNKELNIVTEINKLQFHLNLQSDRKSSTSLTNMTNILSMSKLGSSTGLSSVAETNAAAASSSSP

SEQ ID NO: 22835 - protein, 87 aa, Candida albicans
SLMNAIKSQECIAVSPHTSSNPRRSEFHFRSQLVVTCVSRVSMVSIVFPKKKFEPKSEFKDSMFSLRHTGIHNPISSSKQTNFTPCD

SEQ ID NO: 22836 - protein, 64 aa, Candida albicans
LTTNGLGVLFFCCSFFRTTRFTIKQHQPSGYENKKGGVTVIFNNLKKTKKMASTYQLNQKTPPV

SEQ ID NO: 22837 - protein, 439 aa, Candida albicans
WSCAGVLKINSFGDLGIVAANLESLELHKCYKLLYCENLHQFQHLKRLVIKDCTFFPFDLFDRESFPELTSFEYEGRIFYELDPLSEIPDSFGVFNLIFPSKLELLIIINAKFVNVTWSSLQFPDTLLKLIFFNVTFDDGYLHLGQNLEYISIHDAPKLALKSSFRVPAKADTLVLTADYMIIESMEFMYHLPKGLTNLGFLAHKMGIIMKPLTEKIKWPWWMEIFSLCGFYIDSDTLQLLNFHESGLERIYIRGGNVKKLRAEWFPIGVKNLSLPNMGIQELSDSFEEMKELNSLSLEENQLQNVNPIKLPLSLKSLDVRNCNLRVISPFLVSMLESENKDIKLNINARENWNLNVTDVRKMLKTLKKLKIIISNYSKILTNIVPYSSRMTCVYSDENYGCKRSNNIDDIDLDCDPEELYNGSANCLEKEEEEDNHDD

SEQ ID NO: 22838 - protein, 61 aa, Candida albicans
IPMDVYGFVKIVANDQTLLNGTTKTNTYNVVKLVDHLFEPFHMIITIDRNNCVKLYKAANC

SEQ ID NO: 22839 - protein, 67 aa, Candida albicans
NTLPLLDLFDLGLVIELDELDADDSADELDDIVECVALVNVGVSVGKEFTTDDKVFNGGGARKGGTA

SEQ ID NO: 22840 - protein, 77 aa, Candida albicans
VVSGDFSSMRNEMKLHKYLKSKIVTDLECAFFLPSLQEQNRPSTRPTHNARIFLVEYEKKKTSSLLYSSYHYSLDRH

SEQ ID NO: 22841 - protein, 74 aa, Candida albicans
HISAVSLELIELNMASASTTNPGIYSARQILLLAQLLHSDNINNVDKLTSLNENKIQNIIIQWKQHKINHLNSA

SEQ ID NO: 22842 - protein, 93 aa, Candida albicans
LSTLAILARVFSLIGLSNPSKSPSSSCVCAGCWVEESLSSSKSCCVLSIFIPYSVSSITYDMVGIDYDRNNKNKKQKKNILNKFGTRLLWYTI

SEQ ID NO: 22843 - protein, 128 aa, Candida albicans
ILRTERKKKFCIFDFSTLVNIQYKHPHFLFVDTMSTSIADAFKKLNVSPESSTSEHEKIFNVSYEYLSKVKKFNDLKASKNCLVALINLDKYYKAEQIIRKLPSSLVNLLILEVAFLHSRRLAGATLN

SEQ ID NO: 22844 - protein, 85 aa, Candida albicans
LDLQHHLPNTKEIQQCEYHHKLVSKITRRYPDNNINVTKFPKHLTKTDTCVVNDQYLAPFFLFGSYIDCLLHIAKKKRLIIPTNW

SEQ ID NO: 22845 - protein, 79 aa, Candida albicans
YSHCWISFVFGRWCCKSSYFFDFLRLNSLHNISIVNSTLVGFNLGQKKGTRYVLDSSPDICSYYKDMTYLFLYTSTGPV

SEQ ID NO: 22846 - protein, 80 aa, Candida albicans
LRKRKRRSKKLDNFFLSGHFFSGLLFVKTELLDCLNCHVFLWFVRNSSIPKCVNMYVKSKDKSLTFNNRENKIAKITSPA

SEQ ID NO: 22847 - protein, 64 aa, Candida albicans
NFSVPLGILTKLKTNVVTIDARYNQRNITDKILTGAKPKALSPKEVVNILNTKKYEPMENQDSI

SEQ ID NO: 22848 - protein, 92 aa, Candida albicans
RTRLLSVKTIKLSTFSEIWHRGSEQTGPSGSNKRKEEYETPENVEKQYKSRVLFFYTFNKTKGSLVCEKKKSILMNCLINYLSPFFPVIVTF

SEQ ID NO: 22849 - protein, 100 aa, Candida albicans
HIIIMRWMDGWRERERVWWWYLFCVSMYLEGDTHTQYSLKQYKIKIKIKIKRLKSPNSFVITYFHISVDTIVELLVLRVIIITQFTFLISSKFSGTKNYI

SEQ ID NO: 22850 - protein, 82 aa, Candida albicans
SKEANCRAGDNEPIIFLNLEGLNERPLLLSILNINSTKLVVNIPFVPNLLFTFICRLYEWSENDSVIVGKKNEVSCGVAAKH

SEQ ID NO: 22851 - protein, 61 aa, Candida albicans
RSLAKNKLLELVYCLFSLCNANTKKLKSSLIKIKQKMITTFATVCNLSPLFLYYFCCWVYL

SEQ ID NO: 22852 - protein, 105 aa, Candida albicans
CKNYFFFVCGRLSRVLLVGWTSTKWYHTTKSNCYIALVVYKVLRRIVSEIRSQVMKANVENNTILFPVSYLVALKLLVRRKINIIIRTGCLSVTPPLNQSPRKLI

SEQ ID NO: 22853 - protein, 61 aa, Candida albicans
VITPLNNDTNTCYRVEYNVSVTIIISVHQEKNSKYFLSTIAPYQHIPTITINNKSRHKIKN

SEQ ID NO: 22854 - protein, 87 aa, Candida albicans
  UNSURE (23),(25),(31): Identity of amino acid sequences at the above locations are unknown.
HFQHRVPSITSSLHFSNLIHPIXSXQSRRKXLVKSPGETNLLLDESLNTSSTAIAVSRQKLHHTGLYGRSSAKYQLFPRFNLHQNLN

SEQ ID NO: 22855 - protein, 65 aa, Candida albicans
  UNSURE (65): Identity of amino acid sequences at the above locations are unknown.
GALKCCWTHNKIHCPFLGEWEGKEFNFMEKTRNNPPSKISGQKGIFGHSLFFYNHRNITHYTWYX

SEQ ID NO: 22856 - protein, 68 aa, Candida albicans
DNLYYFSNNMVLLGDIIQLQQNFSNLTTSIPSLDNLIFQTQVKNKIYDVQSAPSCTGMFSPREVPHRA

SEQ ID NO: 22857 - protein, 64 aa, Candida albicans
SIYIKECTSCDCHPNQPTTDGDGDETGFGCNPPIKFDNQPTDTTATFESTIYKFQSISYIKKRA

SEQ ID NO: 22858 - protein, 212 aa, Candida albicans
GEINISHTIGDNFCTNINLRLPFFILLKTFSTHTQTTHIIYNNQMSILRREGALRVSRYTLKNVPLAIVTPINQQLMVMVMRRDLDATHQSSLIINPQIPRLLSNPQYINFSQYRILRNEHKEIDKKELERKINVNKVVDQLREYVPDILETSLPKSIISKDIYLRICPSQFDENYLPKLNGLVTYYTTCKAIQLFLTSVILHHAARRTATC

SEQ ID NO: 22859 - protein, 62 aa, Candida albicans
FFYHIIPSITILGKKKKKENSTIITSSRAGKPTNIDSDWAIKTCIIRVFSKCRVILIQTMLN

SEQ ID NO: 22860 - protein, 72 aa, Candida albicans
LVLIWGNLATILIGMFKISNAEIKLEGANLLKKMADAIMMTNGLVTAPLIAANLSSQFNPCHLPTPAVSCPR

SEQ ID NO: 22861 - protein, 113 aa, Candida albicans
GRGFSMPVGKTLATKSQSTITQIPSSQLHYSTRTRSTTINEINELIKQDYKASHNKFNSNSNGGKIKLLDDVDLEKQLIETAGGKNHVWTFILKLVILTILVLGSGILIFYAL

SEQ ID NO: 22862 - protein, 69 aa, Candida albicans
QEQEQEKKVKSVDSTIKHTFFLSFIENPLNRLTAKKCTQSCIIKYVNFGIKAVMDVSIWYWFNKFLILV

SEQ ID NO: 22863 - protein, 79 aa, Candida albicans
SQPVLYFFGIFYHMLIVIKNSTSNNFLLELKLKELNAPFDLSFEVPITLSLSSYTLNILQNQYITSNIQKRQKIISLTL

SEQ ID NO: 22864 - protein, 61 aa, Candida albicans
IVTKQNVSVNWLLTIVENNNGLINVEAAAVEEEEDPYFCYITNGVHYYIWDIEPLSCMRNI

SEQ ID NO: 22865 - protein, 63 aa, Candida albicans
YIHLIHSKKKLTQAKDCTPRKLSYLLSLLTYDIVIIIALLSYVDCLPELSPPSPPSPSHSTRF

SEQ ID NO: 22866 - protein, 74 aa, Candida albicans
SQKLFLLENVICIYLRIIIIVVVVVTAISKYNSPTFIAQNKYLMRTNTISVNIYAYCCIQNIHFWPGPGCYVLK

SEQ ID NO: 22867 - protein, 135 aa, Candida albicans
RKKTTMFRSILRFPSKISTGVSVFKQFASTTTTTTTINTVFARPSILASTSTTFNSSSPSLVSFFPYNRPTSTPVEFQPLSIEPKEYDLDTVDKDDDNNTMHALSVLRKRRLKMKKHKYKKRRKAQRALRKRLGK

SEQ ID NO: 22868 - protein, 67 aa, Candida albicans
TRHSINQSLACFNLSLLIFHREKKPPCLDQYLDSHPKYLLGCQYSNNLHLLLLLLLPSIQYLQDLLY

SEQ ID NO: 22869 - protein, 87 aa, Candida albicans
YRCWFEIAGIGSSYRFCKRYFSHTFTRTRKSFRKYQSIHSNHIEEFMELYVKLYWCVYAMSHTRVPKFESNIDYGFLGCFFFSSVAR

SEQ ID NO: 22870 - protein, 88 aa, Candida albicans
LAVLAHFNILISSVQFIILELCKFCQYITPWHLQKNLGGGGNNVFGEVLIGRAKNIKMIIHLSPEESIDMDVGFLQNLCTTILLWHAV

SEQ ID NO: 22871 - protein, 64 aa, Candida albicans
ITLSFHYFELYSPWQIKILNFSGTYTVYIFFRGKTNKTRSREKSDLNLYIGYVKSLHQLHFILT

SEQ ID NO: 22872 - protein, 61 aa, Candida albicans; identical to SEQ ID NO: 22851

SEQ ID NO: 22873 - protein, 66 aa, Candida albicans
SLLAKSIVTSFNWVASIAFSSIIIFFTEMYDAKDIDWWGNNVVYKGMDYMMNGWLNATIDAPDWLF

SEQ ID NO: 22874 - protein, 94 aa, Candida albicans
  UNSURE (48): Identity of amino acid sequences at the above locations are unknown.
TRGTTRLLFTLMFQKSKTKMQPFNYQWQLFFEQDFKLILPSSISLMLXIDKSVIGDNYNQYPNVNQERVNCVRVIFYAPLSIYEFIPLCVFKIS

SEQ ID NO: 22875 - protein, 105 aa, Candida albicans
KKRKERTDIYSYILIISFPVIDQFQMSESLNIQELTDNSSIIPIPTESTDVQDVTSVSNKDTTTTTTTTTTTTESTTRVRKSSPSPSANENDKKRLKKEFQPRQK

SEQ ID NO: 22876 - protein, 195 aa, Candida albicans
WGILRGSASFVTDIYPVDYDPTDPNRPKISTYSSDVVHRMSMNYPSPPQTQATSTDSNGKSPSSSSLDNGHQSRNSNNLNGNGYYDQDNSSGSNLTYDRSIIFERVNESPINAHHQQPPTPPPGIIASPIRKRKGFVPSVFRNSSDSHIHHSNGHTNGSSPGVATEEIPLEDFDDEQKRASRISYENQKRVSSMN

SEQ ID NO: 22877 - protein, 112 aa, Candida albicans
PTTMSHSDPDVALFVGLRNLPLDIIAIIIDYLPKCILPNLLYFPPIRKIVVSRILSVVIIATQSFKHPWNTSRYGEFPTCQCTCFLERTKKFETSCGSMENLTPNCTYPQFV

SEQ ID NO: 22878 - protein, 66 aa, Candida albicans
RNLKLKHFAARLQHPPLWSTFGKPPFNLTYLHDNASWKFTYKSYPRVNYLRLQFLVFINKCFVHFF

SEQ ID NO: 22879 - protein, 118 aa, Candida albicans
SLDIQIIMPFRPSYRRRYNSKGFRSNRPQNSHRSEPRTSSGRDRRGYRRYYHQQPSRYAYVEEPDSEIDPTEEDEEDEIINNEEYDEVPLEYYDDEEADFDEEGLDEEDRPPRAERPR

SEQ ID NO: 22880 - protein, 667 aa, Candida albicans
  UNSURE (667): Identity of amino acid sequences at the above locations are unknown.
PSNSSSPATPSSSSSSSQSVSRYHNNSIQAKQRYANHLAKTTTSTNTNKEIKRNKILKIPKLIIKNPNLSSSQLQYLQNLRSRFSDNINEFTYTPIGLINFKIGTTKTQSQDNLINRISNIPPTYVPTLVPRGYVINKFKQYLIISRLGIRQPILVNGNGHTYDYYPRTIVIQSPEGKIIEIPMNWQFYHQSNGQIDKYDSIDKFYHECGIDGFDINILSGGNINNSIFLLSIMKHNIHGNINFILRFNVINSLNDEPELSFQDYTCQLMEFLYDNILKQNLNKSIMNQLFNALGIPLCYFTKDMPNHSIQQINQILQQQNGGGGSSTKQKDKLSRKINEFLYQQEHNPPGILYRFEQYSNTKGYRIINYQTFQDFIYLTISNGFIIKFKWSNYQFSNFELININIENSLQEGQLLIVNDNDNDNDNDKEKEEEIEENNPFYILRTGSKVITIKKKMKLTTTTSSSTNGNHRSNNNSSSRAIHWECKRILSNYKIIKKILLTQTNQLVVISSESIISINLQNLKSISSPILVCDYFNDNDIYQQFELIETVKNYGISCYLIFNIDKNYNQFKLIELDDSMNTTTTTTTTTTTTTTSTIGKFKELIIMIPFQFQKCGYLKNFKLMKIIPLLKDDNDNGNNGNESTSNRLMIGFNFLNHFEMTTIIETX

SEQ ID NO: 22881 - protein, 92 aa, Candida albicans
NLSDILILLKTLSSSPSDLSRNNCSKFITINPERVLINGKLKQKSHRQTIVVNNDGDLLQEKQTISGSGGGFKKKLDDTSSGRLLKKRKTTK

SEQ ID NO: 22882 - protein, 60 aa, Candida albicans
IQWMDDFNDYIRTECIIVISLLYRLGCKKLNEIVIGWQIYKTARDCALRNRITIEHCRIF

SEQ ID NO: 22883 - protein, 71 aa, Candida albicans
PCQKLISSTLSRDTFYNYECPTKSKYTKTELVSLHSVIRNGRTTTMHLVCSKDFKCLYIFCIFQSFYKLIK

SEQ ID NO: 22884 - protein, 79 aa, Candida albicans
VKEFNKPLPDIGNIPCYCGHCHNQSAFAVRTINCVTLFFIPVLPFYYQKRLKCNICGTTGGLDATAMDRMKLGQPVAIG

SEQ ID NO: 22885 - protein, 61 aa, Candida albicans
SPNNTKNSFVVDLYLCVNYPRILLLQLGCIEIATVSIINLTRHLLDLRRKYLVYQFYVHID

SEQ ID NO: 22886 - protein, 72 aa, Candida albicans
KRKQSLFGGFITRYNYDSFNRRENSSIHPLYSPPSPIIIIRRYRRTLVGSDNIYPKLEHSGYIPQYSTHKTS

SEQ ID NO: 22887 - protein, 74 aa, Candida albicans
YKRNESLNIHGFNFFCQMFPSPKNQEIFEDFHHYWCTPLFFFTHTQQLQQIFELTKFLAIMMMTYGPLAIFCDL

SEQ ID NO: 22888 - protein, 147 aa, Candida albicans
LNCGEFNKENPESAHSTGPSIDNLVAFGFNDSIAALIPTGVLTVRVRTSAVFAATAAAEAAVLELNRIWSLATFNIVLMLSWVCICVVNVNIYVRKRVVEYFLIRNEEFYFKIYNISLSKGKMSPIGTDEGEKKTTEQWKGVIIDFQ

SEQ ID NO: 22889 - protein, 75 aa, Candida albicans
SNQTPTYLDFHFTTCFSNVLIQVKSPDRSSQRVQSLHITIFNWSIMKLLYRRNHLSIQPLSKLAGQMDTSWLTKL

SEQ ID NO: 22890 - protein, 89 aa, Candida albicans
TGTMVNEEFMPTMDKLFEAHLSKCISTTETHVRAMYLDTTTNRITDSWKQFIQETVNQAMQPRFPGLFSEPVNILSNKNNNLVFPSPAQ

SEQ ID NO: 22891 - protein, 84 aa, Candida albicans
VSTDLDRKTNESSGNQESIASELLAQSPIQEVVISDNDQQDSTDKVSFNSTMSHPPSTISLIHTTGPLKILKIINSPTTSNLSV

SEQ ID NO: 22892 - protein, 157 aa, Candida albicans
KMPITDPRISRHILTDEDESDEDEYYKQLRMVGNQDYQPTITIELNDNNMVTSTNANASGTANKIKSIIILPPNLSIIQTELIKLGLVKSIGSISIEFPDLYLHDSSNNITTNRRIRKEREIQAEIVHGNGNTNDNFHNTDMDYDYFSSPAGWKDTN

SEQ ID NO: 22893 - protein, 106 aa, Candida albicans
LNGVLKFLKNTFQKMFLKKLERLLNHLLNGYNKLKNNNNKVMMNKFFKKKKTITNFTYLFVCLYVFFIHIYSLLLLLFLCIIAICKFTYLIYISFKEEKGDISKYH

SEQ ID NO: 22894 - protein, 63 aa, Candida albicans
KITNLKHNCITNVYSLLLQITYSGGGVYKLVLTTLYVERSFTVVFDLFICIFFITSTINNENC

SEQ ID NO: 22895 - protein, 88 aa, Candida albicans
  UNSURE (53),(55): Identity of amino acid sequences at the above locations are unknown.
KIPYSLCLNSFILIVCVRVYVCMEVNVWVTSFVAKKQKMKQSECYKRMIERMXDXKKKTKKMRSKKKNKTSPSYRDRQDKNNLLLILL

SEQ ID NO: 22896 - protein, 102 aa, Candida albicans
LNLLVYTNCDLSIRSLSFLNVLKSREIVNTTKPVYSTQKYIIDVFFSYYCVSINLSPSPLNNQLVLYNSQFVNPVRIHILFQITVSACTKFNWSSFHFKVNA

SEQ ID NO: 22897 - protein, 62 aa, Candida albicans
AFIIVIIDPKKQKSTVMILLFWHRHPTKIHAIITWFAPKKNNSKLALSFHHFSIKNQPERIT

SEQ ID NO: 22898 - protein, 78 aa, Candida albicans
DIVPLRLLKNWIKVHIVQIILNNSRNPSISLQYIHSSIFDHTPSKCTGDTLKEDIYSAERVWMNNITDIPVVSNEDYM

SEQ ID NO: 22899 - protein, 79 aa, Candida albicans
FQIDIIQKYILYRTTASTVNSAYICFRVYRGRSTIDEFFILYLTILLNIGGKVSRPACISRIDLEYGYNGERTYTTLCS

SEQ ID NO: 22900 - protein, 189 aa, Candida albicans
IVRNYKQNKTKPKKKNIYEPNILLLLPSSNGFLIILTSIHFSIMTKDDIKLLLSEDLSPYKLTLLIVIHLYLCNELPIPQLITLTQLIENKQQPRPHNLLSTHNIIHSLSQLCELFNDVNVTKQLLKCIWRINSIEQLENDYINNLIKRVKSVDLITLNITPGSTNSGKVVSSKSLFVISPPWKVTYRV

SEQ ID NO: 22901 - protein, 189 aa, Candida albicans
IVPTILSDDPLLGVFNNPKFPPLPKYINLVNNIEEEEQKEEQEEDAIIEDEVEEPIKEELTTPLKKRKLDIESNEETDNNNIIPVEDQSKIFTATKVEKLTTTTTSSIENNPVVIEELTSSKEIVVESPVDEPTKVDNIIPTTTTTTTTTTSLTSNTANANDDNDNDDDDESSDFEMPEINLDQDSDDE

SEQ ID NO: 22902 - protein, 95 aa, Candida albicans
  UNSURE (4),(9): Identity of amino acid sequences at the above locations are unknown.
LARXAHCSXRCSFYGLLKRTTTSTTTIITTTTTATTIAISDSICLEKKGRTYNKITMTKLVNIIIIYLDTQPASYIYIYDESVLSSISNYLLCSI

SEQ ID NO: 22903 - protein, 132 aa, Candida albicans
VSYSIMEDKYIGLALAMSSSLAIGTSFIITKKGLMDASARTGGTDGVQALDYLQNPIWWGGMITMAIGEIANFAAYTFAPAILVTPLGALSVIIGAVLAAIFLKERLGTLGKMGCARCLILHSAGDDPRIGG

SEQ ID NO: 22904 - protein, 196 aa, Candida albicans
IHRLQRIQAELFSEKKKLGSDNNDGQQKVEEKEESALEEAKDGGADLGSGTMGMGANADDSKGEKKPPMLFKLPFKQQLLANLRSNVEMTTTVQQPTPVSSEDDSDPVAVEIPVPVVPELVAIIDKSIEEKLKPIIKQVEASTVTGEDVNLKVVEKVSLVSDNGDNRKHDVKLVPETAAPAKVVKKLSFADYKKMK

SEQ ID NO: 22905 - protein, 73 aa, Candida albicans
  UNSURE (70): Identity of amino acid sequences at the above locations are unknown.
YYLFSMKLITLLGLLPFTLARTFHIATNQNVACLEIKAPTAISLTITIGTASGAYPPGTIFNFCHRLGSXSFR

SEQ ID NO: 22906 - protein, 80 aa, Candida albicans
NKCHWFDPYRTLIAAGTFSTDTIQNGPSVPLIYTCLCICSTNSCTKPCDHTYEYQAVQSVFSFEYDTFMIMLHGSNNGLN

SEQ ID NO: 22907 - protein, 77 aa, Candida albicans
EEKQTKKIEQGLTRVVVRALTIKTPEKKTKMRQQLTLITINIERGKKKKNIKGKGCKNKCREPFSIPSLSVIFFLSS

SEQ ID NO: 22908 - protein, 61 aa, Candida albicans
LVMSNNCLSIDQTFFFWLFSIVARNFLELQKKKTQTRRLTSVKNFNYQLSLIIVTMLYIVL

SEQ ID NO: 22909 - protein, 77 aa, Candida albicans
IESLNEWNVDAVDCGGGARQVGVKIGVFGVDDDVDEIVVDDATGDVEIELVFDDVVNDDTPTNGLLLVVVVELLAKQ

SEQ ID NO: 22910 - protein, 230 aa, Candida albicans
ADYEGGRKKRETEKEWERKEGQEEKREVHAEKSTGITTEEGTSKIHRSKGSASPETQHSYSGVKNGEELNGGARLTESSSSPRPFLNKSFSSDDIIGSSTTSQQRPRYSQRHQRSHRKDATTTTTNTNTTTSNLSRPDFSSLSYADLLNNYCFANSSTTTTNNNPLVGVSSLTTSSNTSSISTSPVASSTTISSTSSSTPNTPILTPTCLAPPPQSTASTFHSFSDSIHI

SEQ ID NO: 22911 - protein, 89 aa, Candida albicans
  UNSURE (9),(10): Identity of amino acid sequences at the above locations are unknown.
SWGQLFVLXXGLFVKKVILRMITILHLLKKKKNIKHSYLLPFIHSFIHINPNVSKYITYILYIIFIFLVSFGLFYFIYSSFIPATALTL

SEQ ID NO: 22912 - protein, 108 aa, Candida albicans
DLSISLKLQKGLNHKFVKTPVTTLLVLTTKIPYYFIEISQSLITITTMTILTTDVDFFRDISKLPSEIIVIIIGYLPKCMLPQLLYFQPIHKEVAFIILLHVNITERK

SEQ ID NO: 22913 - protein, 120 aa, Candida albicans
RCESKKTPVENLHTDGSMDIGTVTFKNNKLVKRFNVVKKENAIINKLNKTKKEIPTDEFIVKQDELIKEIANERKQEEREAKELSKQYEYQKKQNADPYADLFASESTSKPTNWSEDSFW

SEQ ID NO: 22914 - protein, 145 aa, Candida albicans
VAEDIKVVKITKNDSIKNKVEVIFKSIEQDKLILLTGLSNSIAKLICITEIVKQKQNEQQQQQHEPSQKLDQYNKLLHIDSTVNPSYKPIPEKENKKVDTKQLEKEALQEIKGPKIYTLPVLYIVIGKHSIVSNIELVNWTKQDK

SEQ ID NO: 22915 - protein, 74 aa, Candida albicans
KIFDAKGNRVRLYGPGMIKRIGYDFEWFQWEGMKYLLCIYDVNLQIFQDVKKSDLCDEILEHLRFLESTQNITD

SEQ ID NO: 22916 - protein, 383 aa, Candida albicans
FCYTYSINIILPPIFYTHTYTSYQVNALPNSHHTMTDYYEPTFLFRQNAIKRFSPSLSPISSVESLSLVDSNSISNNGTTTTTTTTSSIYQNASNSSWLLNPYNVKDTAILNQSCCLNRTNVKSNYWKIPDESMNLTSMSINKNQGGNPILAISSGKSESNLFIYELNLFNNHLIHHHTISLPNIHAMKWINNTRYLVTGNNKGYAHLVSTPKLATHDVFNTNSNGDFDYNDDDEDDNNSAEICKRFNHRKHLKQNQLENTISTPIKHLNFLNNHENLLSIYNDYLFYWDIKGCHQQTRPSPISISTVSGIKNFDVLENNHTSTNTSNANTVAICGLFGVSLFDLRDCQFNIPNYNTAQIHDKSQSSYRKLSANIVIWCSPRG

SEQ ID NO: 22917 - protein, 69 aa, Candida albicans
PEKRKNLFYCLLNWVASTSDLSSTTSTSTTFTSISFYTHKSFSIRIVNPLMQMIDIYIYIYRLEKECKS

SEQ ID NO: 22918 - protein, 67 aa, Candida albicans
LGRRDRAKLFGGGGVSFIVCIQSPKKISSTAEQRDNNNNNNKLEKSPNKKMRERKINKDNTDSLQIS

SEQ ID NO: 22919 - protein, 70 aa, Candida albicans
NANCGSFQPPWLKNTEYVNEAPKYVREAIRASYDAGCKGAFGFAFATIVLGVISSLFMREHVLHTSINRD

SEQ ID NO: 22920 - protein, 494 aa, Candida albicans
WIFIFFAPIMKTSSSSSLSISRSSNLESPSMSLISSKISNEDSKNKPETETESKVETKGSKHEDRSITETSDQLAKQEQEGQGRSQNEPKQELIQSLNKYVFNTQCGNGQTFNNFPIIVRIPINDKQGRQEIENFVSGCSGISAVYHHQEKKEIDKAVEFFNIGFTTKKELDDLIYKLYQEQIVYELDYSKFISHPGILFIKNLSSNLMFDNNYNHKEDRTEDDYDDDQEETETESITIVESTEPKHKLFEFLMDNSYFKSLQEVKIFNNDNNNISTIPLSSFAIVKFSNHLDVDILIKKYNKYVPNIFNNNTNIPLFLNKYLNRKERFVFPGAPNLANTTNNTTNSSGGTSSTGTTTTTNTTISPTRSMDNFNLIIVENLLNFLPRIKLNEEGFNGFINKFNSFGNLIDQIYFPLSDKGANLEEIKTLDFGFIKFKQLGSNNNNNGNTNIMENTLRILYYLNGLTWEEFNQLDVNNLRSFLQECQFEQREATK

SEQ ID NO: 22921 - protein, 94 aa, Candida albicans
NKQKAEEAKKKAEEAAPQKFDNFDDFIGFDINGNTNAEDILSNMDYEDLKLDDKVPATTDNYLDMNNILENDELILDGLNMTLLDNGDHAKRRV

SEQ ID NO: 22922 - protein, 84 aa, Candida albicans
FIIAILLADSFGYITTPAKLHLIHSPDEFYATVISLFVGLNFPTTTAVNFIEHENPAVTDEPEQVYDQDSDDEEVELSYIRPGP

SEQ ID NO: 22923 - protein, 73 aa, Candida albicans
NTLVSSLSFLIQTNNKRVYLNPKFAHVVEFKRSILVKSLSLSLELFVCKFLNFFCAVDEDGFNEIEVGAGGDL

SEQ ID NO: 22924 - protein, 145 aa, Candida albicans
SSKEMNITNKFQHTPIQGQPQSNLQAQQILLLQLHQGQAQQQQQQQQQQQSSAGVLGSGFQPSDNFGESVNQNIYQNNYQSAQPSLQQQFFPQFQQSQQQPSQQANNALQLQQPYQPAQQMVRQTSHFQQQQQQQPSLQQLVFSH

SEQ ID NO: 22925 - protein, 66 aa, Candida albicans
MKTGLMKLRWGQEAIYRRELFTISYSILVISHVKCLTPFISRVLSCVCYCFGKLSMSQLQAIFMKK

SEQ ID NO: 22926 - protein, 66 aa, Candida albicans
NCFEVLWNLMRNTSSPYGLVVKPLATRKEKKKESLQVPIITLQKPCFAIACSYDKTRLLCVRSFLG

SEQ ID NO: 22927 - protein, 194 aa, Candida albicans
YISSPCGPIEIFFFFGNISFFLKKVLITLYSEDLQQSNILSILLQYTQSHVPAIKEKCKVKYQVQQAQNQQQPYNQQADNEKMRFTLKKIFFVFLTLLIILIGYLLLQSVDLQRIRELLHDSEKFDLESLKQASLEIRKEIHYTNYLFSGYDNFTQQFSDEETLKQTSLNDKCKLVFTQWKESHPDFEFTTFEA

SEQ ID NO: 22928 - protein, 237 aa, Candida albicans
RRTTTIDETTTLPPVTTSITKTTTQLYTVIIFTDINSETTLTGDYTFIHTKKTRTVLNTDYVTTTIQGSIVTVTQTTTDIVTEIVVTCPDHDFATTLTGSATFVPPTTAPQPVETPTPEPSTTSEIPSITEDTTTSDEATSTTESSALPSSTISSIKSESYVPSATTSVLDTSITLETSSSSIEFSTSTQESSSIRTFSSSSIGSCTSSSISTEESLSTTKLLSNFTSISLSGRVII

SEQ ID NO: 22929 - protein, 76 aa, Candida albicans
SFNNAAIYGQLISQHFVSILREEKELAGFTYHICCDTTFSGFTLQEDRFVRRTKNKTNNSQHLQTTQQNQERLSTY

SEQ ID NO: 22930 - protein, 66 aa, Candida albicans
GVRDIISQSKWRYNFYTRKLMNINLPKKKVLQQNESSQLNGGGSNKKRNEPKEIEYSYYDLLKNLF

SEQ ID NO: 22931 - protein, 117 aa, Candida albicans
  UNSURE (8),(66),(73),(75),(79): Identity of amino acid sequences at the above locations are unknown.
KKESKKRXREKESQKKKGGEEEKRRRKNEREDEGKRKEREEGEEGREQGREEEKEEEKERKPKKKXKKEKKKXKXPLSXPPSFFPKTVKLRNYINIILSFYIEFKKKRGKTNKRKRE

SEQ ID NO: 22932 - protein, 79 aa, Candida albicans
ILAVCFGCAWAGQRVGERHECGRGRRSFHSIPSPHSSPSFIHLITTAAEEKKKEFRCRSRANIMKYSIFGKFSFNGLHW

SEQ ID NO: 22933 - protein, 79 aa, Candida albicans
PIISRRRTKFHIKISSHSLGSVKSAEDIHYKNPKETRMEGAELPVKLNKLVKKNNNKNVGPSFEKYLMWQSYLKLVLKR

SEQ ID NO: 22934 - protein, 75 aa, Candida albicans
EMYNFYTIDEDFRITFIPFTQEDTFSKNYEYWKTILTNELEQLVVSIKGKNFSISIETKEEPMFFTTELPDPRLG

SEQ ID NO: 22935 - protein, 95 aa, Candida albicans
TSRLLFSNIIFLFLLLNNLTEVNFLYFNIILNCKKKIEREKKNHQLSYYLQLRIKNIKNNPIISYYILGFVITICFTREPHCSSIFQNLKQVLYK

SEQ ID NO: 22936 - protein, 88 aa, Candida albicans
  UNSURE (83),(87): Identity of amino acid sequences at the above locations are unknown.
NIVILFLISKFFPASFIKNQTIIMLYQQSYPMTNKLLNASAAGSTSTASIIDGGCTLSKPGSGKTKSTTSLPSCTDFLFYIRXRPTXL

SEQ ID NO: 22937 - protein, 68 aa, Candida albicans
  UNSURE (2),(18): Identity of amino acid sequences at the above locations are unknown.
TXIRLRIIHPYLEKKQGXNSSRKVSLLVHYPTGNLTTHIFITKISYVSAQIKSNNTCTYIYFSILIID

SEQ ID NO: 22938 - protein, 103 aa, Candida albicans
YRIDCGYYKDHTLLLLLLQVYKNCKLVYIFLNDNNNTITKKFNSHDIYIYIYIYTSFNYRMTISSINTIKESIGQFVLNQLNVEIPTIYIYMCVCGIIKCRAG

SEQ ID NO: 22939 - protein, 175 aa, Candida albicans
FYYLKSLYIYLSTYLSIYLYLNHFHYSFFLSFFLSFLFIYCNNVTCLSPPSPLLPSPLQEMSLNTSTTRSNTTNTSKRNLQPSSPSPPPSHPHPHPHPQLVLDLINHYPELRLPSQHYPHTHTQQPPTSPPRMMTPDEFSFSFGSWHNIDIRVPESILSSDGEELDLDSNLPHYN

SEQ ID NO: 22940 - protein, 78 aa, Candida albicans
INLMLKYLQYIYICVCVALSNAEPDKMLLIKKKKDAVIIIKQSPINASMSCIYIYSSSSSSSSNLLLLLLCNMIRKHV

SEQ ID NO: 22941 - protein, 81 aa, Candida albicans
LVDFIIFFYFLVLLFEVTLHLSIYLSIYLSIFKSFSLLFLSFFLSFFFIYLLQQRHLSFSPFSPSPFSPPRNVIKYINYKI

SEQ ID NO: 22942 - protein, 107 aa, Candida albicans
CCCCHSRKYKLICSFCILVIIIIIMCDPYNSHNQYDIKRSIFSDILLYYSVLYVFINVLKYVLSSILRLVNQVTINYCSKNRIITLKILQKFYIKRLKSSPRDCQSA

SEQ ID NO: 22943 - protein, 239 aa, Candida albicans
YHLHCNSLNMTDKEKKVNNSNPQEDVLRFSDDDSMSIQDADISDSEHDLLIRLSQQAQNRRASQNQYHNDINVIGDDSHNDTTASLDLEVVSNEHDIEDHLDDEIIEEDDDDDDNSDNDDNSHDHSDDFEDPDSMSMMETADFLRQLMQARRNRTTEIRNLNSDSAGQSLNEDDDEMDNDEHDNINDDDDNDGDGNEDDEEVEEEEDEDEDDPRADLLRAIVRLRAAIETAVMVIPAPL

SEQ ID NO: 22944 - protein, 62 aa, Candida albicans
SLYEGNRDVYNRLSTTPKIDFHTSNVAKKRSKKVGHHPGTIIILLFAQRRRSLDIILYMITA

SEQ ID NO: 22945 - protein, 60 aa, Candida albicans
LYWCLILPWIYKFIFVFCMLWWWSITSLVTHETIDLHVSPLQQPFVRKSHINTQCDQKIV

SEQ ID NO: 22946 - protein, 102 aa, Candida albicans
TLAQVYQQTMDSPIHIGDLTTQSIQQKLFETHINNNNKNKTINNNCALLSTIYSSIYSGVKTIQLTVKLDSDKNNNNNNDLKFDNKSHGEIIVLRRVQDSVG

SEQ ID NO: 22947 - protein, 74 aa, Candida albicans
IIRKKKREDRHIAHINPQEFFTLFLVNVSCLSEVIYSNNIIQNSSSVSIFRIFKYMIVKNGIIQLYKNNRNRNS

SEQ ID NO: 22948 - protein, 62 aa, Candida albicans
FVNATHYTPFLFGSMLLQYSYVPLQVLAGSEKTTVSIALTIRSQNSGKVEIIEEEGAPAVGP

SEQ ID NO: 22949 - protein, 61 aa, Candida albicans
GKGRTVLTNNLKENVVHKSHIGNKKYVESVMTSKKNSESKKTYKNTEPYRYKYYNSLTTFL

SEQ ID NO: 22950 - protein, 66 aa, Candida albicans
LSVSVHYARMLFGGDWLLNSSNHNGGLLILEMKVLRTVIKKINSRLLFRGISLFIYYVKSVFFFFT

SEQ ID NO: 22951 - protein, 66 aa, Candida albicans
GLKSPHTYTRGRLSEPYNLHDDINTPYIRYSIIYNHNLKYLSLCLSPVIFLVLRLPIVVALDVLFI

SEQ ID NO: 22952 - protein, 86 aa, Candida albicans
VCSRGTTGSEGPNSTSSSFSIRSFVDFETILSFFRLLLGEEEGGGGGKEGKFEMENITYTNDTVINPVYNQNPFLLSLLINLSIGV

SEQ ID NO: 22953 - protein, 67 aa, Candida albicans
NYLVHDLNLSHTCFTFSDPTGIHYYYLLMTHTQQVLVNSFPAPLLTHPQQANKRTEKFHNLPKLFHS

SEQ ID NO: 22954 - protein, 163 aa, Candida albicans
TKHLPKHQNTLMYTIIERYYTPIDRFINKLRRKGFWLYTGLITVSFVYVIFSISNLPSLPPPPPSSSPKSKRKKDKMVSKSTKERIENEDEVELGPSDPVVPLEQTHSNDHIINSWSKRQLYQFLCEEKIYPDVDEELNTIKKQVIEIYEFKKQHGTLDKKYI

SEQ ID NO: 22955 - protein, 216 aa, Candida albicans
SPHSKMSTTSATTGSSTASATGSSNPGNILIADLPPPLHSHTSPNIALSIKLNQDFIHQLKSHMAKLPSSSSGNKVKLVVKNGQVSIKLNEQIQYPCLKFPENLTIDVYSNNNYDGRIINKLTVVTDSKKIKQYNNSNSVGNDTEKDREANSNVITPISTPRDLHTPIIPSNNNRKEKPLSPQKQKSVMDVYWSINLIIHTQYCLHPRGLDGSALN

SEQ ID NO: 22956 - protein, 92 aa, Candida albicans
INNVINKSVDFLSKKEKIVAAKIQFFFHCCLVFLIIAGLQKELIYAGICCLQHVCSNRNTPPRQTLRTEALSTPKSLYIRAEHIGLDQCVNL

SEQ ID NO: 22957 - protein, 188 aa, Candida albicans
HWIQQTDLAKTATTTTARNFNMQTTKYKPQYAKQTYPKTPNSNQYAQPDKEKNQTYKRTTPSNQYKKKTVNKTINVNQQPRRSRWGLGGFRSMWHIPMIFMFWRGFSKNRHQPQPQPQQNESINVTNINYPSFPENATAPVQHSQPNTNNTEQSLPSSSQNIKPKQDENHSVFLYHSAEEEKEVDSYY

SEQ ID NO: 22958 - protein, 69 aa, Candida albicans
IIAYPLILAVMELKLTAANSVEPNLPTENTDATVNEYCNRKVTIKGNEYLIMTLISLSIVVFGSGSISC

SEQ ID NO: 22959 - protein, 117 aa, Candida albicans
RHYEVRTGLIHLYRRVLLIPRESNLVQDLANGIGELAKLHIESRSPADICCIFCLFTAGCEVLCPEMQQFFEQRFQNLGQMGNINARKGLQIMKRCWKTNEDWITAAEKIGVDLTLL

SEQ ID NO: 22960 - protein, 102 aa, Candida albicans
SRATRKYKMFFFSRAFYLNTEQTERALKILKSREEREKIYNSLLLNNKHYYRLSSSAIFYLILELLVVINKIFENRKTEHSPIAHIYLYIIVNIFFFLIIHI

SEQ ID NO: 22961 - protein, 223 aa, Candida albicans
VLAMPAAIRLMKKTVSFSKDVSNNNNNLESDSDTKQSPQSYLTFIPQIKNSLLVVPFHNIFILVGMFYSGLTQDLETVMWKGFLTSIPIQVIYNYIIYINLLPLKKSTRNDHQNNSSGSAINNNNNNNNNNVPLLIGSSIFVSIVLSLPLFVVIILMGAPVYKYSLKTLYLSLHLSQLIFNPLIILSNLNVNKIKRLFKQDHLYRIIFHHGILSSVLFILTWP

SEQ ID NO: 22962 - protein, 72 aa, Candida albicans
PKKKRKVSMKFESKFLQSEWSLVFFHTFFFVNRDNKLSYRKKIMSQQNLSTFYLERTTPKKQSPANNILIKY

SEQ ID NO: 22963 - protein, 173 aa, Candida albicans
FRSNDASFRLVKTSVVLAVTGSETEIENLDCSTVHDTDSQDDGNCDNNNSIPIADRNARTRCFEYLIGAIDEAWARYCDATTSFEDDVFGSNKLGNSTTKRAYNGKLNDNNDNNEDYDDDDEDDSADETFDNNTDITDYSDFPHQQTIASTQASSKPDQSSCQLQDLKVRLTK

SEQ ID NO: 22964 - protein, 67 aa, Candida albicans
FFGFRGWRRTVIIVNLIIKPRAKTLTNYCYSVTLCAGLGIIPERYSLTMKETYNISFIGNKFTSTLK

SEQ ID NO: 22965 - protein, 125 aa, Candida albicans
TMLRTALGASKHSRAFRRAMALELRPLRSYSVEQPPPQPITETKFAAVKDYMKKVQTEDTQESEKVLKFFRKMGAISIVAVLASIAYAAYEQSYNGNSQIVEEQQLIKLPDLSQDIRYQQRGDEK

SEQ ID NO: 22966 - protein, 87 aa, Candida albicans
DNGIASYQLITSFKDVVSQFCLQNNILMKPLKDELLLQKGFPVYQFSQNDLLNKKICGYIDDDVLWVGKIDDQEFVPINLENLTNYI

SEQ ID NO: 22967 - protein, 60 aa, Candida albicans
RKCKKKGRKLASVGDFKFISIPSAQLVFEPNLFIFTAINSKMLTPKLARRIVCGMGFCLF

SEQ ID NO: 22968 - protein, 66 aa, Candida albicans
  UNSURE (12),(14): Identity of amino acid sequences at the above locations are unknown.
LRQYYGLSGWLXKXEQELYRERKRERKRVKRKKEWEERAASPTLPAMVGRSEKWQTVEFSIGTGSR

SEQ ID NO: 22969 - protein, 76 aa, Candida albicans
NSKDQFQTETSGSLQTFPNVTLNKVHYDSIEFNSPELQLYNNYTRLRPILLLPPMEVNFPINTNVVRIDEDNHFLT

SEQ ID NO: 22970 - protein, 66 aa, Candida albicans
YFFFFFLHQSILSNYISLQKAERFTKLYFVIEFPKKKHLTTKRKRETISFTPPPTRINFFLTPFTQ

SEQ ID NO: 22971 - protein, 247 aa, Candida albicans
KGNTSKPEDNPFVIKLRSVKSTINKKYSENLPEVQPIKTIIGMSHQQILHSDLSDVKIKTLMTSSSVSKYAANAVKFVTTHKDDLFGNFENKKIFLTLCINIALYESLGYKKTTKLYPNVLELFGGYAEINLETTRTKLTPSKKDIHQNDLDYSVLSYFGHILIWAAHQQRQGKVPIFADKFGISLTSKEVRSKIGGYHLWDKLFRELQGMNSKRWKHVIKFRNAFQYEEDQFMIILRFMQIDENIP

SEQ ID NO: 22972 - protein, 71 aa, Candida albicans
GNMFVNVKCLYYFFLSYVISIHQDLLRSSFVLVGATKQMNTILLAENIIPLSEHKHYPSLRDMGVVFPYLT

SEQ ID NO: 22973 - protein, 239 aa, Candida albicans
KRPNKQVTLHEDTKPGKRLLYKRQNYSAAAAAAAAAASTGTGPGNTLPITTSASGIISQLSATTPANVAIQGNSQIQTGQIHDVMSSQDTFNSISRQNSYIPPTAQQLPHMYNMSQSTPASSQQPIDNGNTLIGTSNGGFGQPEFQPVSNNNMPAYPNDIQNFQMFQRMQQQQQQQQQQQMPTQQRFFQNGSAPNPIPQQILHQGKVLSSQSSNDSNWSFSNTQKDSDTSINSTAEEPR

SEQ ID NO: 22974 - protein, 96 aa, Candida albicans
MIIEYDTRINLAMVAHASCFIFFFSMGERRAGGSNNKNKASGIAPNGTQFKLKFGHNHNKLAKENFFFFTWENCLTYNLLLTILNSFSFINIFKIY

SEQ ID NO: 22975 - protein, 61 aa, Candida albicans
EKWRIIKPYYSLPNQVKNVSIMILFIFLVALIDRSEIQFTYHHNMLDFIIMMLHLDKTYLF

SEQ ID NO: 22976 - protein, 151 aa, Candida albicans
QSNSKILSQHPSTMSVVQFINEINQTYSISDNRQKIDQLTRLLSINPQQNKYIAIIYNSKSIPSTITTLYDDDWSAFSLILTSFIKLCHLMDPWSLLKSFDLYTTFLNDLSVGFNNNSYGWLLSNIIKDTISQMVPWARKLCVTTAWKDPH

SEQ ID NO: 22977 - protein, 95 aa, Candida albicans
YVANWFRNSDSVNDGGNNRMTNLLFGEIIGTEVEDEVVVVVVGVPVVVDDKDGDFDSIPGAGPDLLGVIDAISESILLGALFFLVFMVLCHLLLF

SEQ ID NO: 22978 - protein, 66 aa, Candida albicans
SLCFGELRAKVRKGKKKKQQKIVRIDTIRSSSSTPSKLPMLLKPVDYTLEQEPYYYQHNHQYHVLK

SEQ ID NO: 22979 - protein, 67 aa, Candida albicans
KFYTTELKLTLHITDTNFDNLHKSGWFIKLYMFLIEILNYLRLRDIFQLIKLYSSNVDEEAIFDNMT

SEQ ID NO: 22980 - protein, 560 aa, Candida albicans
KIWLMVKIMQSNPLTIQKLGHDQKTQNQDHYHALPPQPGSCTISESSSNNSLTKSTLSFKGWEIPNKGSTSITMDPCQVETTLSSSSATGIPIRGTSSPGSLSMAYLSSSLNSSYSSSNYSLSKLGGSFMEKWKNSFGSVSSTSGVALGGSGIGGTTSGGISNGFNNSANGSGQNHTTTAVTNGSYFDDLYNFSKRTSPYSLRTPSPAVEFDEYNFSSTKPINIVNNSLSSNFQLQLSMTPSRLSRTQSMYDLYGNKPGGMMNVMTEEEDMSEAEDIHQKSESNSSTNSNNNNAVTGMLTLELKRTKTSVIIPLIQDNMIKNISEHNQSLIKEKCKLNMEHKLKMNRVVDDNVLQVESPCIRNGTSHNEHIVFKNKTLIPVVAFSDEFRPEFNVQSCPINPKLEQQVMAGMKQDLLFYQNNSNYDEIVSRTIFISLRAREIKLIEMNINNKDNKAFSLPSSPTKQMTNNNGTTSTTTNNTYKTKIKKIYTPTKNNGNKELINKIEKAFSEIGHLFAIQQQLYQQHNNNPNRTNDSGYNNSEITKREFHEKLCKLVLQIIN

SEQ ID NO: 22981 - protein, 74 aa, Candida albicans
NCLLPIVSNIYKLFTPRILKFNITFKFTFHFCTVNKYNNGDAYLDVKYDAFYILILLFWERLLLYYALFNFYLI

SEQ ID NO: 22982 - protein, 83 aa, Candida albicans
LTTVEFIVVVVVDSEEADANKRENNFIKLFIMSFAPVLLFFFHMINILLVIVNNPYFLARTCTRQVQDLFKLSLNTFSFKLLV

SEQ ID NO: 22983 - protein, 68 aa, Candida albicans
SCQRTILGRKKNPRHPERKKNNKQKDTKKKKRGKHFVYNFQSTYLILRVGTSSSCLVLSCLGEGCLNN

SEQ ID NO: 22984 - protein, 172 aa, Candida albicans
KCSKTRQNKTTSSNNSKQPFYMNNANIVANPLIMNVIPIDNLEDPLAFGITSPGVPEEEEEEGELDSLAIGYVDGTDATEIKVVLEAVTVEISPLALESAAETPLLLVLLLLLLLLLLLLLLLLLLLLLLLLLLSGPVPVPVVVVVAVLTPVSLEAVDVAVLSDVAILAVLD

SEQ ID NO: 22985 - protein, 110 aa, Candida albicans
EVSDAPEVSDDSDEFIVSEASEVVADPVVSDSVEDPFVSDAFDEVFEVSLDSVVVVEAEDSSPLVDDNEAESVLAVLVVEETTELLEEEPSSGALGTGLHSTLQAEGNDF

SEQ ID NO: 22986 - protein, 250 aa, Candida albicans
  UNSURE (31): Identity of amino acid sequences at the above locations are unknown.
YNLEKTCRGNDNSSVTSSSDGCTDSITSETXSYSSTPLYGDSSQVSSGTTGTSPDTMPSSQTDYTSSGSGSLLVSPSSSVVQSSGVTNSTPNTGDVNTQSNTANIATSDNTATSTASNDTGVNTATTTTTGTGTGPDNNNNNNNNNNNNNNNNNNNNNNNNNNTNNSGVSAADSKASGDISTVTASSTTLISVASVPSTYPIANESSSPSSSSSSGTPGEVIPNANGSSKLSIGMTFMISGFATMFALFM

SEQ ID NO: 22987 - protein, 63 aa, Candida albicans
  UNSURE (23): Identity of amino acid sequences at the above locations are unknown.
NDESKGRREKDNFPVPNYLIMFXNSIKKMWLVEMKVCYLVPTGLNWIMFSPPKGFFLFWLNFG

SEQ ID NO: 22988 - protein, 382 aa, Candida albicans
SILTSKTLHIIPLLKPEFEGHQEVEYSEEPESKEDDIDEEHPQLNPITDELDKDQDTVEKTTLSRKRGNEGDLESSMKRLRTAVGSFVTGIFNRKDKINQNFENNAEESSPNQTDDDNETGTKMDINNKIEIPILEKELEILETIEEADSEEYHRDEAEQIYQDNENLELPFEQGTDANFNEEKPTDIASIISSKKIFEYRRPVIMKRRTRRRGRRTLKWLHMITNELELIQADKLNESRLIENQEPNDEEAEVETNNLLEGLNASDDSVENNRNVMNVKKEVENNLDTDSDVQNEEQKINLPKVRDNSKKKQSIKQRFMGLLPEELEELGLDPNAVSEESNEDESTRRGRRLRSRDSKPSFSLQSSPVSSIELRERPASEN

SEQ ID NO: 22989 - protein, 60 aa, Candida albicans
  UNSURE (60): Identity of amino acid sequences at the above locations are unknown.
KTIGKKKWPVLHQKGRNNRDDIPIFQVDEIIRKYKKAVFCIMNLNETGKYVDIDRNAKTX

SEQ ID NO: 22990 - protein, 60 aa, Candida albicans
IFKIVKIPVLFFFSHILAPTLMQKRKALQLKILLISASMPLSAFYDSFFFIFKMKRKTHI

SEQ ID NO: 22991 - protein, 73 aa, Candida albicans
KGKRISKLYQIHTEKLKLSTQNIVNPGKQRRKEKKRRKKQYQVVPMNKQSSPIQQPLAPCFFLLGCTVLTIIY

SEQ ID NO: 22992 - protein, 95 aa, Candida albicans
HFFSNFSIFHIPICINTYNSSMFQYIKATQRNRLTNSLFSSTFAICVLLVGANSAIPCPVDSNYSNDSNEKLQQQHKKFIQQKQNIHQSNKENEI

SEQ ID NO: 22993 - protein, 568 aa, Candida albicans
WGTVTLEWNLVLEQCPTERIWKLIHLAVSNIRDSPYLTASTMKFILPYFILVEYTMSMITKLNNKPSSCDSNPLGIRYWQLFFETFSGDLFEKLNFEAGAKTKEAESYFILCRILEESGVWWTTIIKALQVYEAFDLSLLLESVFCLCVFARKGFSWEPLQLVYQKAILEETLGVEFYYRYLEIVYFMNQRNNWPLPETVVLQIYSSITRMKFANFIDEIGMPDLIGKVSNRFDIPDDSFFERFMQLLYWYISGLSEPSKVKKLVTKLFTFSKFQYVNDQSHHVMFINRLNFILLLALVCKVDLKTQLLNLLEGIENAKDAKLIKLASQGVCVLTEIAIQRDTKLPIEGISIVIQCCINGYYNVHGILKVWKNFLISLKDLFRDPLSRLSHLLQLLNISKSIDINNVPDKIIIDICHVLSHITSSMINVKDLVIQKHIKTIKSFNEFVLSLLHRQMGRLPLPSVIQENRVCDLIEILLSIWVQCAFVLDESWDRLILQTYAYTGNQQLREQFALYFYSKILQFNNLKGCKELVTRQVLRDLVCFNPSKYLCSILHKVQKEKCVPLTRE

SEQ ID NO: 22994 - protein, 63 aa, Candida albicans
PPPINQGSLLPDVKNMVVLFAGFHFVTFDFRNLIFKRKIKDLKFCLYNNLRIYKSIVLQIYQL

SEQ ID NO: 22995 - protein, 63 aa, Candida albicans
STLLQPQYFLIKCISFYSSLEYIHSLDISNVYFQEQLQQLNIYQATSFRQKNIEGKSCSFFKK

SEQ ID NO: 22996 - protein, 64 aa, Candida albicans
QNEYKKKCRTPKKKKLCLSSMLERKTINKWYPPELQPSKIPRTKKNATRPIKNRMNGTLLDEVV

SEQ ID NO: 22997 - protein, 60 aa, Candida albicans
TKSTAINSITNQNPLPPPVQFPAAPPLHPLAPTQPAEVELLSAPHTPPISTTLPPILAWP

SEQ ID NO: 22998 - protein, 80 aa, Candida albicans
NSYMGDSQWYFVNFLTLFFFVRPARFILGHHHCSSPPQQQQQPATILINWYDFATTDPLVQNVNKNVMQHFFFDQLISKD

SEQ ID NO: 22999 - protein, 390 aa, Candida albicans
PQIFFGFVLNNILISGGVFYYIVVLIMTSTDEDSGKNQFSTPKAQQLSTNGSFPLIDQKTKPQLDMEKMRDILVEETCLYTKGVQDTDVDWFITDSSIDPNADVQPLVNSPRETNLNSQATIPTSHLTSAISNSNENYTNKTKPSIAPIQEENIASDTSPRHHRHEIEQQQPRRRSSVSVSTSGGFLSKLKSKFHKESPTPPGNHQDGLFKSGYSVNPDKKSNDSSNSSIASLSSSPKLVSGSNLQRTMSTPAYTHDTCDPRLEEYIKFYRKSDRRASVASSSHSAKDECLPSVLVNASEPTNYNKTKDEVNASRVSGFFKRKNSVAMKNGETSLPRSLVSVSVTPQSQVKNGLENNPSFQGLKPLKRVAFHSSTFLIDRLHHRAWKEPR

SEQ ID NO: 23000 - protein, 67 aa, Candida albicans
  UNSURE (1),(2),(4),(31),(52): Identity of amino acid sequences at the above locations are unknown.
XXVXVRPFANAPQPKFFQQKNYSDYNSAHTXYNSLHLLIHFIILRFLVVVPXIFFSIFYFRNFCFFN

SEQ ID NO: 23001 - protein, 76 aa, Candida albicans
HQKTKVEVRQPNEKKKKSGQILIIVLLFQFHFSSSSTIHIHIHISLLSFNTYITVQFKKKKPPSNEHWKFPRFNTN

SEQ ID NO: 23002 - protein, 61 aa, Candida albicans
MYCQSNNAISTLSQNLEHFKVLRYVEYYLASLSGASRFLHFLLKVTALALWKIKKNVNCYS

SEQ ID NO: 23003 - protein, 71 aa, Candida albicans
IDDCILTSLLPYTSTDYQNPAYTFIAPLPPSYFVHLIFFWIMVLGYYNTNTLPPPNINQLVTPIINSYQQP

SEQ ID NO: 23004 - protein, 66 aa, Candida albicans
SITVMVLIGISRGIIQNSEYLESSSTLLKKNVVEVNSVLRFLGGSQNLGQLFFPKNREKYETIIFK

SEQ ID NO: 23005 - protein, 60 aa, Candida albicans
GVRQETRKDTIIYLPILYSVNLKRVQGVLKGKVFNKFRMIVIARRPGNFSLNLLHNPYCI

SEQ ID NO: 23006 - protein, 63 aa, Candida albicans
PTDGWTSEPNCNKYMWCAYSSIGGRTGPEETSHKETLYGLLVEYTPEEIAYFNYLGDVWVGKY

SEQ ID NO: 23007 - protein, 131 aa, Candida albicans
  UNSURE (69),(122): Identity of amino acid sequences at the above locations are unknown.
FDYYQYTIFVHKSSSSSSIMFSTSRQLIKSSLIHRSYSTTTTTNGAPIKVTTTTTRKKVGAFRGGFIGXLLGVTTTGGLSYYYLLDQYKLANTVVIADIVALQNSITNLEKHIKSFEERKFXRRKRGRLRT

SEQ ID NO: 23008 - protein, 75 aa, Candida albicans
RNCIFQLLRRCMGWKILIKPTRYRFVYIKEKLFQPNGGGKSLIFVDYVDLINLCLYKIASQSNQLTNLSFLPTYH

SEQ ID NO: 23009 - protein, 369 aa, Candida albicans
YMIFKLNDYNAFLTSLFDKNNEQLQRHQSHQLQNYNQSQNSNTIMTFANNNNNNNNNNNNNNNRNNSNINSEIADDENNTNNGNTYHQNGGFPVDFDFGLAPPPFIADLPHNNTNNGNGNSNNSKYYSLPLSETTTTSNRYNNIDYELPSNTEFIAEIGAYVKDSKLNNNDNNRTENLQSKNSSNNTNNSNQRNTTTPTKQNNSNNDNVVVNDIDQFSRFNEFGSNLGDPMILEQDEQMNNSDNPMIFNLNDQMGNNFNNELNRSSQYSNYQQQQQQQQVSQGQIFQDQVSPHSRMSNIPQPISDHQRIKSNNHEYNSNLQSPMSIETAPSTSTTTTNFNKNTAPKTGKKSRNSIKRSSSSPRAGKSAY

SEQ ID NO: 23010 - protein, 69 aa, Candida albicans
QSIFVAYQPIFILLFQYYIEKYHRFHLLSLISLHVGTYFCIARSFKSFSLSTTDTYQVVFFSNNLLFIL

SEQ ID NO: 23011 - protein, 392 aa, Candida albicans
NKKVEAYKCYQEGLYIIEKSIKDYNITVPEKLFTSLKTQYKALNIELKRKRTMAETKETTKLVKKTRIRTTDPFAYFPVDILELIFQNIPMNQILKCHTVSKLWYHTLTSIPRLYDFKCRANIALNEFVSGVRLFKKICSYSNSKLVQHVRINHACNKQHLAKMLDILIREQGILPRNLSIMDKNFNLQLLFHLFAKSGWKLLNFQNLESLKIGINCSIKYGHALLNMFKKLKALEIVILVSEKSSLDLIPIQDKLFRRFKDQELEEYGLERLLLVNHPKLLSDNPNPISPQTYSPYPILLNRVFPGLTELTLVSFDFSTTLPQFGEFLMQTPKLEKLYLENNQAINMLIFFQMLVNYKPTFKLQEFTFRDSSVVSAILANRHRQPMKSCPT

SEQ ID NO: 23012 - protein, 112 aa, Candida albicans
AADITKQVMYLRYVIRLRSPAQYKVEQNESKHRICHSPNNNILTIKINGSTNSYTRVYQHSCNTIDMYDIDCCADNAIGVGYKICRQVCYRSLHHSIQPILESGDLPIISSQ

SEQ ID NO: 23013 - protein, 560 aa, Candida albicans
YFQFMANTYFIYSGINDENGYGNKNKNHYYYKQDNVTKLKIINEIKRKLWIKLSSVQKIKIMKQYYDLIMKGYEIDEKNDYQLIKITHDKFNIMTKAGEDDCFPITSKTKSNKVKYNTKWPTLIIKHNLTTGYCKIDGVSLLDGCNYYLWKNLQNLQNLQNLQNLQNCLNDYEKYQILKQNWINLNSKEQLQYQQEYENVLKSGKILLFGELKPITPKLIEESNVIKIKYTPIWGEQFKSVSYKNPVKLENLRFLINQTVGNIIVVGKSKSKGKTKTKTKNNLDYDYAWNYYLAKRLNQLGQNIDNVSDNYHLVAQEWGNMTNEEKSNIDKEYDNLLLSGKDYLNGEIVTIEKKISLMNNNQGKGKGKNLIHEIFGQDLVIPTKSRRGPGGYKVKTSIPVLIDLKSGKGIILDDIDLVYAYNYYLGLMLRKLGKGKDKDKDKDKDQDQDKDRLHHTVDNISQIENQWILMLQQEKLQYKSEYESLLRDGKDMLNGEIVSLREKFEANKTISSKISGQGLKRALFPKSNIDFTVKLISSGSGGDDGEIGQDNHDKTDKEFI

SEQ ID NO: 23014 - protein, 92 aa, Candida albicans
SQTSPVQVVPHMSNSTDQMSFWEQVELQGTDGYEFNGEFMLDFMEFIRAIRPQDYEDDDLKDIIQAPNQYEGYIGQDFELHQEGVHNLTKRE

SEQ ID NO: 23015 - protein, 62 aa, Candida albicans
LYFLPTALFFTGFLDFLEINDLSKQTDSNRILLSLTFGKPLIPRSQLKSERKPTTSNPVYLP

SEQ ID NO: 23016 - protein, 93 aa, Candida albicans
EAKKIKALWNYKIQAFIIVKRLNSFVSLDRYTMSTIKYTLRFVIWLIIYVIPTVSLFNNTRIESAEDLSFLQQIAEFAKWEEQNLYQRPADPP

SEQ ID NO: 23017 - protein, 292 aa, Candida albicans
TIWFIFPVYILEYFSLALGNNYTLDTGDHNCCNVFAKINEGESFEQVLNIDSNSVSFQLTNDIPGKFVPLKSFHINKLVDISKLIPILRNFLVLINLCRTVIKSKLTQLPVFNSKRRRSSRFLGIPTTERELTEEFKHKLKESLKLPDDVTDEEILGLSAISETANYSTIPPANKDDIDLESFLGNEDTTNSGDVDTNGKRGTDHLPVNGNNYFLLKLESIDLSSRGDLQLAFESQFKSEEVYIPFRISNGEIVKLQNSDDMETDDTPSSKFIKALNLTEDIISSYKAVYSN

SEQ ID NO: 23018 - protein, 60 aa, Candida albicans
DRLCFYDTVVLESDQHPVSGTLSRSDYSWDIKKTEIELSLNGVCKVEKIVSPKGAIKCVV

SEQ ID NO: 23019 - protein, 79 aa, Candida albicans
KLSIPLSEASRVDYYMQAAKLERQGRRKTRSIDNPDYHNDDDAEKLARSQETKEQQKKKNTTTTTTKKLLLRELNQLIA

SEQ ID NO: 23020 - protein, 286 aa, Candida albicans
ACCMKIRKTSEFIHLITMILSIFISISSCSSSSHSNSHSHSTSMSISSLASTLPIIHIKDDIDELTYFDLTSITTSTVYKINNDQALVYENNQWIHVQTTSTPIIHSKFIPISHCLNQKWGDGGAIDFQTTTIYTMINTFDLALTLSIIFYYEKLTHSWEFSKVLTLRDIYYCSVAPGEIGQIWIDLQYHEFKSIKYRILENFPKFTIHNREESNNNKVISSKNRKKKFLLKKKLKFGKWKEISKMFLLNGKKLPIISCITTNDNKDKQLDCEGKSLLKLKEFKMF

SEQ ID NO: 23021 - protein, 66 aa, Candida albicans
NPWQFNSNALGVWELYSKPNQTEKKKELENESNPTHTDRTKECEVSLQPFLFLSPTTIPLSQPYNI

SEQ ID NO: 23022 - protein, 75 aa, Candida albicans
  UNSURE (9),(28): Identity of amino acid sequences at the above locations are unknown.
IITVSDVPXPKSGLATGTKSTLFPKPAXLFGCVKSPHIKLEATEETSRDSTNETRNDYEYLSWENCFTVFLYYLC

SEQ ID NO: 23023 - protein, 117 aa, Candida albicans
VQSGGTRATAGTVYPILGYGCAGCQRLYHSLVPTYILGTGLLPPLARKSGLAGTRAGAEIKLGPEPEPESEPGPEPEPEPEPEPEPGPEPGPGPGSGPGSMADVPKLKGNGQSQSRV

SEQ ID NO: 23024 - protein, 69 aa, Candida albicans
TGLIKGRNTHLTELNDLITIIKKTIERKKRKLKTIIVVVKRFTHILHHINVNGRIILGSCYNNQFLFQI

SEQ ID NO: 23025 - protein, 70 aa, Candida albicans
FLQLHKVIINVVKVTSSSLIGIEDANNFQLVCVYGKREKNNIQQNKPIMAISIEIHFLAFVMNRHYTSCP

SEQ ID NO: 23026 - protein, 687 aa, Candida albicans
  UNSURE (388),(687): Identity of amino acid sequences at the above locations are unknown.
QDIDSISVIPKNYQPSKELFNFLQLFIDMNIAFCKIYFLILINNIFNFALVKMKTISILAFLVLARLIEANDLFQVKTIIDYQDLYLHINPNNFQVKLSHSSTDVFEFDESSNKLFCAGTNDIITYNKENCPYIMKFADESLSSVLGWSLDRQTLRFDHDLYFSGTKPPYSLLDDPSGCANCRKLNIFRTVLEPKVEKEEEEEEYDGEEDDDDESLTEFESSTDFPTMTDESTEVEPSTTTESAISTTETSKDEESSTTVESTTTPKTTTTTSVDSVTTTSKSNESLTTTESNESSITTESKDSSTTTDDSTPESSTTETDKTETTIEEQEEESTTSSQSEETEGPSGGNVDSTVAMVISAMCQGDRVYFYSDEQYITLLNGDLATFXIDDGYLPVNNNKWVNVNIERLLELVDNQEDATQGWIINDEGIFLVQDGFYSDSVSFSACGHDSGYRVYLGEENGCEPLNQFRIMNIEEDEIDETETTESTKTTETTKTTGPAETTDLAESTDDLNESSAPPPTEDPSDIPSATTTDEATVDPSDEQSIAPTSEPNDESTESEEPNESVTVTGDTTTDTSEQGLTTFTTETTATVTDCEDGDDSCTPRTTIRSTVITTHCPIVTKTEVETIVTDLTITLTTCIDETICEATTLVVSTTVVTTTLTTHVVVTEYFLNAHESDGSSTIANEX

SEQ ID NO: 23027 - protein, 75 aa, Candida albicans
GAVKHKLRILSCSVGEDAWDGRISYEIQILFELGYVTWLIMNSPHCIMVDNVTEENNTLIYFLVRKYVDLSVRPL

SEQ ID NO: 23028 - protein, 194 aa, Candida albicans
QDQAQAQYRPQPQYHPQSFQIPNNAPHKNIFNFKLEISSAPGSIKHSNVNFISSATEPAKPVFLFPSNENTSKSNLKLNVQNQQQPVQSFNKPVHNFSLPTQSTLNKVPLTAPSSLSFGITSPQKEKEKEKVKPLEQPDTKVSIPAPVRTYISVVPEKVKLTQSKMFPLALQQVFEQILQDTIKSELQVFFPNY

SEQ ID NO: 23029 - protein, 118 aa, Candida albicans
CIFGSLFIKLIEFSTQPSAPHYNAIISNRRIILICSGSLVSTGIFLQLIIAAFRVLGIRNISLCTSQPFMSDIYSTWSTNALYVEGGVLYAIFFTWWVPLSDSIYAKRAARYHNKRVP

SEQ ID NO: 23030 - protein, 122 aa, Candida albicans
FYFCETGKFDMLCHFSSIHYQHTSMPTQRTSRPATHEQISKSRVVNALILTFLTVLIFLVLLYHFIWAVQVMMYQPYGNLLNNIVYGPGTLIANAGLSSKLIKYINTKLVEDKIEADYKKYI

SEQ ID NO: 23031 - protein, 71 aa, Candida albicans
TGVFYYRKMQEFESPWCQYFFFIPEKRLRFISSSTYLHAILAVSSFYIQGTATYTSSSFPSTQCEKCDDTV

SEQ ID NO: 23032 - protein, 66 aa, Candida albicans
QTQFKRKPNSVKILTQNIILSINESRKISDIDSLFFYSLLIFRESPNQGKFNGKQVRFNTMVILKV

SEQ ID NO: 23033 - protein, 77 aa, Candida albicans
IIKELYDFNLVPIQDKIIYSKHLHQNNKRKKTEIPYYLLSYSFYKLEYSEIPHTHTKQYKNRLNRIRVIEETKTVVK

SEQ ID NO: 23034 - protein, 396 aa, Candida albicans
MNGIMTTSSHSNFYNQDLVGAPSSSDHIPGPSSQDQPTNNNSPQHHHQHDQSQTTHQNHPLNQPIHHHPTQQNQLESQQSRQSHHLQQQQLQQQQQQQNQHNQQNLASSSTSYEMPSIYQQFTGSYQLTRVPENFLLENANYYALQPGFPLVQAADYYSTPTTTSANDYQNSTINLIISPSFQMGSVSTPDTQNSSIRSKQQQQHSYQQQQPQQLLQSQHQLQVPDIFYTQGGTIGGYVTTKQQQKEFSRKTSGDQTLVPQTNSKLQQQISETSYLQQQQQQQSPPTPQKQQQQQHYQHQTTQPYGGTGFMLYSQTGGPSSSPVAGNISIPTTIATTGQPNSQFQFTYGSPQQGSSSKTNQMYLYQRQQQQQQQHQQPQSQQSLHHGRWKDPHLRP

SEQ ID NO: 23035 - protein, 233 aa, Candida albicans
  UNSURE (187),(208): Identity of amino acid sequences at the above locations are unknown.
SMSCTSYQISIIYLITSYSTTPTLSPNFNFLQPTHNLNYIYHSLPLKMDNLDPNSSLQVEKLRNRKSRAVWQNNNTTTHNNPYANLSTGEKSRSRHNTGSSYVSPYGGGNGEENAYTGNNNKSNTSGNLLQVPGAGGGGDLNSNKKQSRRMSIHVSARQHGRSFSQTGPIDMANLPALPKIGGVTTXGVGGAGGDVMTRNWGLTIEPXIFPELSQGSAAEVDDYYETSLRPKN

SEQ ID NO: 23036 - protein, 66 aa, Candida albicans
DDQGNGKGVFMIEGRTLKAFRGFHNCLADMVEILGGIFQTVVLVCWGCFGHRILMIQHLNILDQRR

SEQ ID NO: 23037 - protein, 88 aa, Candida albicans
LLSRYGGNFGRNIPDGGFGLLGVFWTPDPYDPASEYSGPEEVISEYDSDDLYNGSLDNEYSDEDDEFYYGSSMEEDSSIVTSDNDKDS

SEQ ID NO: 23038 - protein, 128 aa, Candida albicans
NKLFSFSICCLFPIPNLTIKETEISTIYSVFVLHVFVLSNIVWQILQFIKILVQAPYIRVLFFSFLHIKNQVRNTNYNTPENKVREVKIKYIKKKRQRKRKLKFTLQTVSFFKPTFIYLTTLKSQNIL

SEQ ID NO: 23039 - protein, 461 aa, Candida albicans
APPVKSVLPVKSALPVKSALPSEVSSSSEVSSSSQVISSSEVVSSSSEVVSSSSEVSSSSEVSSSSEVVSSSSEVSSSSEVSSSSEVSSSSQVTSSSEIVSSSSEVSSSSSEVVSSSSEVSSSSEVVSSSSEVSSSSEVSSSSEVSSSSEVSSSSEVSSSSQVISSSEVVSSSSEVSSSSEVVSSSSEVSSSSEVSSSSEVSSSSQVTSSSEIVSSSSEVSSSSSEVVSSSSEVSSSSEVVSSSSEVSSSSEVSSSSEVSSSSQVTSSSEIVSSSSEVSSSSSEVVSSSSEVSSSSEVVSSSSEVSSSSEVSSSSEVSSSSQVISSSEVVSSSSEVVSSSSEVSSSSEVSSSSEVSSSSEVSSSSEVSSSSQVTSSSEIVSSSSEVSSSSSEVVSSSSEVSSSSEVVSSSSEVSSSSEVSSSSEVSSSSQVISSSEVVSSSSEVVSSSSEVSSSSEVSSSS

SEQ ID NO: 23040 - protein, 100 aa, Candida albicans
GRGSSTRGEDLTNLEFVLAVLDEGDNVGCFSDTNDGVGVIDEVEAVVDDDDGLASSCDDDSCCVDEGNTIGFSGISELSSGVLSVSLLVILSIYIYVSLY

SEQ ID NO: 23041 - protein, 74 aa, Candida albicans
WWRCWRKCKLVEQKKKIEKRDLKGTTNRKKRCQCAYSGLLTKYYTSNSCLYMYCISSYVNGMNTFSTPEGSFTS

SEQ ID NO: 23042 - protein, 68 aa, Candida albicans
YLKVLRRKKKPKKQKTSTDNTLFHHLIIMSYNGIGLQSVRGSATSGHIQKNIANQISKQSAPRPGKRA

SEQ ID NO: 23043 - protein, 68 aa, Candida albicans
LGFPIFKHELNAELNSLLEKNNVTSSVFMWKKTKQLNSENHAMRSFYSKLRDTNTASPIGVQIITCFI

SEQ ID NO: 23044 - protein, 71 aa, Candida albicans
ILILFSCMKIVNVSTLSYSTVDSKVGPTEVIAKVHLFFMCVLGILQKDGRKKTKPNAKNVPKKNCGTIGST

SEQ ID NO: 23045 - protein, 61 aa, Candida albicans
SQLGAVLNMGTNEPQALLHLDWGNYIIGFNKDPYNLLLSSGGYSSGEGAVVSFGGKCFGSW

SEQ ID NO: 23046 - protein, 129 aa, Candida albicans
TLKFEYETEIETEIETKTQLEIQFDTDVEIEFETEYETQIETAFATEIGVSDVETSSVDTSSSIADVTSQSIESSPIESVVDKDDNNGDNNDSDDDEDDDYEVVVQEEQILILEEEEEEEDEPETAKKL

SEQ ID NO: 23047 - protein, 67 aa, Candida albicans
SLPRKDSHILHHVEGGGKGLMGKTVTKASFHHLSQKLSPEITNYSERLGLSSKAELQFITTLQWQRF

SEQ ID NO: 23048 - protein, 67 aa, Candida albicans
SSNTTGSSNKCVLLLCWKLLCTYLSINISYQLLPHFCKLKHNQLINEHLLKYINSCISPVYFMSIFP

SEQ ID NO: 23049 - protein, 111 aa, Candida albicans
SYKRIFYLSFFPMFSFRDETIHIHVDLYCKKNKTTKRRESKSNLLVPRNKRFPSGLPVIILMFRFVRLIQAPQGVYYKSRVIEPCICEGSGVWGSFTITSRKNWINVRVVY

SEQ ID NO: 23050 - protein, 83 aa, Candida albicans
WLFNLVSFVFSSLVFVYCFINFRRDNMMKQACLIFICICQYYAQLLVKYELRENFRSLLNSLFFTNTKGFKLGNLLYQSRTEI

SEQ ID NO: 23051 - protein, 65 aa, Candida albicans
VDDSSLEDDSCEDEGPSVDDDGSSVEDSVEEEASADDDGAVDDSLEEASVEESVDDDGPSVDDDS

SEQ ID NO: 23052 - protein, 61 aa, Candida albicans
  UNSURE (17),(52),(57): Identity of amino acid sequences at the above locations are unknown.
MSIALIALNNTKNGKNXCFNNIFNYIFFFLCYMCHLMNRFMKQKSGIDEILXINKNXKPDF

SEQ ID NO: 23053 - protein, 327 aa, Candida albicans
  UNSURE (2),(3),(21): Identity of amino acid sequences at the above locations are unknown.
FXXRPLIINDYDWDDPARFKXTNASVLPLDFNSKCHIELTRICTLVGRIVANFYQDKMIDVKKTKNLAIQLRLWSKGLDPELAFGNVLNPSQISNNEDNGNTVILLGIHILHLWAVMLLSRPFFMFEAISKINPEMRKSFEEEEELSKQLCQAATKASILAIKLMNHYINTTFHEIKRMECYVIITCCFYASIILGITILNGTFEEAGYTENDLMNLLKDAQYILSQFSVCNKGAERYSEINLDLISALVNRHKGKEVKPVVDNWSCNLFNDFNFGDTSGQNDVQTMMDFQQFFVSLDLIQFEEITDGTSSLPFDYNNYNLFFGDKL

SEQ ID NO: 23054 - protein, 81 aa, Candida albicans
GICNIEQLNKLAVIAINDGGTDKKYLSYKDNSQRNLATAVTADDILDFRLGRTLLFSISLVVLLDKLFRSMANCRQSSKVG

SEQ ID NO: 23055 - protein, 252 aa, Candida albicans
MTTFLTTTSSITTNNLTNNLTNTNTSSSTPRTNTGTTCTNNVKEDSTNDTSTISTTGYLAKYPNFSKCVSFNNLHPQEYESDFPYTTPIYNLNNQQQQQSHHSGSFFDSNYTFGSSNGSSSGSGSGSTPKIFMPFQDFNFGNNSNNSSNNNTSSGVGRRHSSSAGTTATSFIKRKRLKLPPPPAKSILKNKVSQQQVEYNNMFENISEANIEYHKQEREQEQQQEEEEDNDDDNSQSGSNGGSGNSSVNSSP

SEQ ID NO: 23056 - protein, 90 aa, Candida albicans
TSFFPTFYKVLSTVIKYIKTGIQQACEFSICLRFFCFRIFFLSLSCCILPLRQNSEYYIYVLQWLQRKHFILPSVSQISVLPPEIYQLNI

SEQ ID NO: 23057 - protein, 67 aa, Candida albicans
CNYTMNGIKPSNTNRNPYQGKLANLRSIRFYNLHLNVSDNVENNSNHATTFTGNIQNKRNYPPTRNP

SEQ ID NO: 23058 - protein, 63 aa, Candida albicans
TCSLLNRSTIDFYNPIYIRDTCKCCRIKLHKLSLQAELREAYCLSIRVILLPEGFEEGDSAKN

SEQ ID NO: 23059 - protein, 166 aa, Candida albicans
LLIVPYKMSERKKFSSRISLIFNYNLSNSVPTQSSIQNLGSHSKSIGAPRSTPSNSKPSGSTSSPRPLSKPLLNTNNSRSNASLVTSTLHNNSSVPVSSRTDTNRKIVSSKPSINTLESHTHSNNNNNNSNSNYHMNNNNNFNNDPYLNDNITLPVQRHNEGSIDP

SEQ ID NO: 23060 - protein, 66 aa, Candida albicans
KEVISWTTLRKRHFVFQNERVFNKKGGHIRLEQDTITPTKKEKYGPSCKVILVCGVFTTDCRNALL

SEQ ID NO: 23061 - protein, 75 aa, Candida albicans
REEEIQVKSNSCSDNDESDKLVLLDDGILAVKRTFLFSCIKKALFKLFRIGLMFNFNSNNTKKLSTAQLNFKPGP

SEQ ID NO: 23062 - protein, 69 aa, Candida albicans
LYTYFIYKFTFLFLVLLVDRIIVGLYGDQYYLTSLLLTLILTQTRFENPHYPKFTSSIVCHFVYSLHGG

SEQ ID NO: 23063 - protein, 186 aa, Candida albicans
  UNSURE (167): Identity of amino acid sequences at the above locations are unknown.
TKMKFFTAAATALLFSAQALAGITQYTLSIEADDERVNGKGITFKHEGAGINYAFVSDSSAKFSYDDESKHLFYPINSQISYNLGTEGDIVQFSVTTPSSVEIGDDGALKFEGSDELFAAVSINDPYHYSDKDFAIIVQGKNMLIQSHLLLKKLIMLLKLHNWFIAXKSTQNKRLEKSRKYLLVKI

SEQ ID NO: 23064 - protein, 105 aa, Candida albicans
  UNSURE (18): Identity of amino acid sequences at the above locations are unknown.
IGSFNSDDGKDSLLKLLXTNREVLVLIRLLSGTLHVNLLTMVNPTFFYNPAVPQLKYNFVMEADIIQFSVTPPKSVEIGEDGVLKFEDSDKLYAAVSINDPYHYC

SEQ ID NO: 23065 - protein, 159 aa, Candida albicans
IEFVNRKISISLKNQLNIKVNQYYNRIPKDFLYQDICDLILEGDSKTLDRISLKNIINHVTVDVGSTEGRDKSNTSSSSIVEYIDEFLLILINEGEYLKATKYMIQFIRKFKDQFKVPIIQYETFQYLLKLIELNSSVDELSPINYGLLQLCINHYQRN

SEQ ID NO: 23066 - protein, 116 aa, Candida albicans
FKFISTESYLYILSFMNGLCVYGIRVSIRSTSAVQLLRRSVSRGRLTNASSPLYMSRRHNSTNQQQALLDPQDRINYIKLLKLRKEVRKYLNRICKSKNINFIKESIEYQGESILQ

SEQ ID NO: 23067 - protein, 394 aa, Candida albicans
YINTIQDFSLFIKHINGFNLHIFQVLLNVLFNNLVVDNDVGIKVQLEAFVNTLLQEIKFEFSNENSFFGELFNFMPWNQKNYILDILETKFLLETNLDNNQIKLIINDRNLLPPLNDFFKKFSSSSSSSTSSSSSSLVQTIETDSSFFLNLFNFIGNLVNVANSQELILEQANSINDTISIFLRILIIHKLYLCSMISRNTNEENVILFVTKLIDLLNSDYLTNHNDKLRILLYDLLLLMKSSVSEEVNSTTELNENLQGNRNGTGTSGGGSNAISPNQDSILDDQNTNSTGIGKGQKSQIGVTNNNDMLDVAPTVSLIQVLFDLPEPNASYPFKEFIDDKLVKCSIMLHEQELQYGGDYHIFNNTGLYLISTKNESVSLTPFVPGLNKTAGDY

SEQ ID NO: 23068 - protein, 553 aa, Candida albicans
PRIMEVHLKILENLPVLNNRQCDSILKRWTPTGFDFKGKFSQGQSILQDSIITKICNNQLTDDIDSQCIGYIDSLSVGLRFLLINWLTNELKLKIKSTNKLIHFTPTVITKLYQFYAKNSGLTVFFKVVIQTILKNDGGMIIFYLDSLYLISKLVIRHYKLIKSIAGASELSAAYDLFKLIIQVYKDLNTREYDCFKFSSIWNFINAVIEKSSPTSSATTTATTSVSISSLYLTMGKPKNSKLKSVQGLHVKQTMDSPMCINTVDESHTHDTRSGAKRYTSTDFRNDLYFLVTLQPRALTSEEKQEVFDLIEIELKDLDSALEFWYNNFELLGEEKEINLMKIIKSLAVTTYNDHLSQFNEKLKQFVISKVGESIDHSKLSNFLKKLAIFDLLRINDLVKLIQSIQRDEINHIDDTISFIYELIWGELDKAHFSCSQLVLLQISRRMYQEKSSYQCIILLQQRLLKNKESQLQTNPFFIKYKADLLSFFHKAIITNTKAIQSQFFDKLSHSDSLQLLNVLLQRQENDTLTQFKTLVCLLNISTDLTCIFFKYC

SEQ ID NO: 23069 - protein, 87 aa, Candida albicans
IINILKKIEIVSLMLLACSKINSCELATLTKFPMKLNKLRKNELSVSIVCTKEEEDDEVEDDDDDENFLKKSFNGGNKFLSFIINLI

SEQ ID NO: 23070 - protein, 84 aa, Candida albicans
VCDSSTVLIHIGESMVCFTCNPCTDLSLEFLGFPIVKYKEDIETEVVAVVVADDVGEDFSMTALIKFQIELNLKQSYSRVFKSL

SEQ ID NO: 23071 - protein, 152 aa, Candida albicans
TVNNPFIKKYIHTILIIFDSFFVFFNTLKDIMSNMNYQFPPSSPLLEDYSYNSSKDPFTSVASAKSKVAEEAAEARVSRDNYPTPNPSSSLFRSSSPAREAYGDNDVFRPEPKQTANINKDFNVLNPDKSVMRIPLVNTHTHLQPAGRRSTY

SEQ ID NO: 23072 - protein, 164 aa, Candida albicans
QKLLNFLSGGITIVKMKIQKVNNRVKQLETPIDYNYDSLKACKCDSCDYWSILSPSQSSSLFLGILIPIIWLINLFRIINCLYFTNSEPLAATAYLQIFKTKVRMKSNVPLTSHYIEYHNNNRVEMYSCLGHILAAMMIYGLVLFAIIMAFAKVKKSCDFGPNN

SEQ ID NO: 23073 - protein, 110 aa, Candida albicans
LVSTMDENVDFYIFLFSVFFLVKILEFQQKIPVFDANPSNYSFIRGLKRKKKTTIFGRVLLFMYYNKFTLRAINVVPNIVDDREDTLGVLESNPQCSPNKTNDHNLQLMD

SEQ ID NO: 23074 - protein, 215 aa, Candida albicans
CNYFPTKQILLYIICQIITMSDARICVALFLKVLQLVGDLACFATSIKAGGHYNGLIIAVTVFSFIYNIFSNCLGWFGMKGTVDTEDVRAYRQFVLGGGTLFFLFYIGSSIFQLFTGYNNNLNNFGYGSHLKPYHHYASWCIGVTCAVLYCMQVIMCECWGITFASIHDLSTGFFKRQPFKFACLVFGKSQVDHDCEDNNNIGLKSMQHNTSNST

SEQ ID NO: 23075 - protein, 68 aa, Candida albicans
VMYGSKSNTPAFTHYNLHAVKYSTSNANTPTCIVMIRFKVRTITKIIQIVVVTGEELENRTPNIKKEK

SEQ ID NO: 23076 - protein, 62 aa, Candida albicans
RKFEEPNTSPIRFLDSLKNSQRKRQKLFKPNILDMSFETAEVLSSPHNFYHRNLHHRLKDQH

SEQ ID NO: 23077 - protein, 88 aa, Candida albicans
LNNFVKEKKKISTLFNVRICSMCGISSSFLLFNSILLVNIFYFNYLYVFMHQLLNYQNNRKKKMKEFLSQLRNKEIALCKKLHDLDLT

SEQ ID NO: 23078 - protein, 62 aa, Candida albicans
KLKTTEKQENEVKSPNHLIYKKGETEFHLYIYYTTLLKSLVIGSYFFSYIPLLLLLLRKNYL

SEQ ID NO: 23079 - protein, 423 aa, Candida albicans
NMTAPSISNQQLPPPPYSKTDNLPTSNYQLSLNGSVQGQDQQVQAQVQGQAPELVSAAETLTLLTRNATPPSDADTVAMDDAQSPVILPPIHPQHQRHPIVSTVSMVARHPIVMNAVKYYETSKRNYPSFNYAAGIVESAAIPVVNNIEAKLNTRHQTRQASAVSSTDITPTNSNFGDYKIQHDGKNLLQKKRRFSASSQTTNISSYSSIDTKKRLQFCINILKLANTNISSKVEFLQEKIDETEIAVKEEREKLIAQKSHDSNSTNTTEQATQKTKTEIVGTVKKIIHLISNFRPSSLGDTSVANGLSPVSSNGSQSNQDFELKNAIRDIIMSLPQSLQQQQQLQQLGPPSNSQDDVIFKFAKESLVMISKLTQIFTEKLDQVEHWVNGDEEQEQKLQLQLQLPEGLEKQQEVFAPGLEDPR

SEQ ID NO: 23080 - protein, 88 aa, Candida albicans
SLSNNMVFDTRTLIFLSKVLNVIAWLIEIDCGGKRVAKLTWWLTMFEEQLLEPNSSYFNYVVAVSVLSQQNSVLGVAQVSQLLIRNST

SEQ ID NO: 23081 - protein, 143 aa, Candida albicans
QTTMVSRSHSSTPVPIDASHPIHSLNIGNQDQIASLSIQTPIILLYQQEENGFQTPELVALRNSNKYVFVINWLYNYRGYLKLQSELFDVDLFELELLGFFSAFDLSSLFINKLKLALITSVQNSKHVELEDPEFVLLSQLAE

SEQ ID NO: 23082 - protein, 61 aa, Candida albicans
IAIKHICLVSYFPPIHCFSIGSVVDICHLYKPFINKMNDQLVELRFCSAFTINNSTHTYSK

SEQ ID NO: 23083 - protein, 63 aa, Candida albicans
SSSIKYHVVGKTLNKGIKNQTIDGFITDIKIGKLNPTTTTTTTTTTTTITTFQSLNLFPISLL

SEQ ID NO: 23084 - protein, 61 aa, Candida albicans
SGILTKPANMSYKENVQIIIILWSNLKWEKPCYTSFTSLLLLANIGLDEEQEVRKLKGGKS

SEQ ID NO: 23085 - protein, 64 aa, Candida albicans
TSKKKQKRTTNTKIPIQQQQQKKCQRQQNKGKTKRNNKVNSSTISTTTTSGKKKSQPSFITPTL

SEQ ID NO: 23086 - protein, 64 aa, Candida albicans
FHILVLYLSSTLGSQLYYLYQNHFSFRKIERKCTLIGQPTIIEVYITTSLKLPSGIDFTSQFKR

SEQ ID NO: 23087 - protein, 168 aa, Candida albicans
  UNSURE (1),(2),(10),(11),(19): Identity of amino acid sequences at the above locations are unknown.
XXVFHWSKKXXTFQTVKLXSMSCPQSIDDFIPEQFKLLDTISSHSNNFVCFCNHCHSKLFDETSSAGVQEDQIQKLLNNHLLIKEVHCIACHGFVGFKIKSFIPDQYGYIYKTQKVGGLNDFKNFLLCLENGISEEQRYAKFIKTNKKYIDKYFICVTNVVANFKSRS

SEQ ID NO: 23088 - protein, 61 aa, Candida albicans
LPLMVVFLSMERKQINTRKNWQVKMGCLYKGMYELWVNPKKKLKQKHGYTSETEVMVKTVN

SEQ ID NO: 23089 - protein, 285 aa, Candida albicans
QDYNLIKMGYPPNFKIVTKSLTENILLASTAFSRVDKFNFGARMAVFKFPQSNKIILWSPLPYTPQVIDVLTKFTNNTNESNLNIAYVIIPDREHNLAAKSYKEKFPGCKLIGMEGLDENSLKLDYKFIKLMGNKVLKNDELKQIFNDSDSGLIVDNFEFVYLPNHANQELVVFDKSSSTLFEADLLFNLGVPGSTLGETILEQYSPELGFPKGFNPHSGWSFITRYLQPYSKVGRFLFRKLVDINHSKPGLEAIYNSWDFKTIVMCHGNIITKDAKEAFKHVFV

SEQ ID NO: 23090 - protein, 580 aa, Candida albicans
QDLLKSATQRSIALLDTPPRQPHKLSIITKAEKNEIDTPEHETNGKESINNDDDDNDNKENRNSSLVNDKLKVLQKKIEIEAEVEVDDDDDDDDDEDFDKKAFLQTPSKVLRDVTNKPKIQFQTPAKQKLLAPSSPSTIIISSPAKGDDDDDEQKEEEEEGNDKDGIRGNKKGKSNIVINIENDKDDESLMVPPSPTPAKNLPKKPMMGVFSEKKSNSTTGGNQNLFSHFNNKTDDIIGNNKFKNKNKSKHNQLAQPLQPQLSQSQSQPQPQSTTFNFKDNRKKAANKAKMQAGMNKFQIVLTDVHTLINKKKKNTKDDDQKKQQPQQQQKQKELQKEKQQQTSNNKSDKKIISKQSTQSLPPPPPPPPQAPTLTTTPQLTHQLSSLQDHNVTMNSSKDHSSIISAGNNSMNTSHFNITTDHSSFEFGGLSSTPNSKFLLDKIFEKPSPQTTNYFLQQQQQQQQQIQQIQQIQQLQQLQQLQQQQQQIILMIPSQDGSNSTMPPPLGKQQQQQQSVQFIASQFPLMTMTMSTPQHQGIINYNPQIFTNNGSSINNDGNSSTTSSSNSQETSPDGLFNYGQ

SEQ ID NO: 23091 - protein, 82 aa, Candida albicans
EEEVMSTHNIILDIINDSSSSKIDQLNQLQNVITQLSKTELLELNVSSINIESFKLIVNLLKIESIMTNSPKICPKEPRPAS

SEQ ID NO: 23092 - protein, 413 aa, Candida albicans
RASGGLLYDHEYVSVIQSDKRLLRFPILAKYKEIILDRGHFKGRIHKNLSSQTGKLCLDKNSHNQLSISYGDYLAVSTPYSQGDLIYHVLWFNFKNFFADSLNIIHHFWFQDFLIVVNRRSRHTFEENEEVDDVNGNGDYLVDEFMVLDASKTKYGMGGEEISFTSDSLMWKYDFKSTFIDINLSEPTKGKSQVVILTADHRLIVLDLSTNRLIKSDTDIKHYKIFISVNKTVNLSTINAKIELNQVVQTSMINNRHFLFLLATGDIYLLKNQSRETSSSLSSLRTPIEAIKPSNMYDLVKLHSNIEFFKFKSIKFENDIEFVYLFNGQEILVYEVSELIEKSYNDNDREEKPEDVLEFKEEEEENLLPICIHTDGMQPFEFDAVFNHKSLDLIGLNTLAINKPKSGGLFIRN

SEQ ID NO: 23093 - protein, 354 aa, Candida albicans
  UNSURE (1): Identity of amino acid sequences at the above locations are unknown.
XGGGEGGGRDLNETLTSQQIDEIVRIVSERRVAKFPKKFVCSDLMKEELAERLRYECLDNIQYCIVTNPLHPHVLALNELFLQKDLASNSASDIEKKQLYIKNPETFKLKNIINRRFAMEDSLDLFKPLERTNKIELYFPVFHDGQVEDYKNVFNLPSHDQVRKLLEHFVGSKSSIKDYAKKYHSEKKLNSIEEYAEFINVISLGFKKRLPGLSLTVIVPAYINPEELKTKLAVELNDTIDRVLAVPDFLVSGTNLESESFMFAGLDTLMYQTAFTEGNIDKKLNLGVNEPYGDLLHVHIWRLLSSTSVSRKKRVIFALNGNNASSEDLSRIGQIFAFNNISGQLEIKPFVRVS

SEQ ID NO: 23094 - protein, 223 aa, Candida albicans
  UNSURE (199): Identity of amino acid sequences at the above locations are unknown.
VFFGGSLFNLSEIYFYISICYLFIMKFTFKFPISTLFKYKPQKFNFGLEQEIRLKLNSLPSVTKIYTNPDGSPRVPSDEEFKTIAELQNLYYKRNYSEWNWILPGIPKDQLQLFKDNSQDLTHFRFVSKDSGKIIDKIPYKDASTGELKWKIIRETSKAEGWEIPYFYIVLPVFAYIFYVKYTQQTKLRELEGPDWGEXGIEIESHGKIISMGDTATSQRIFE

SEQ ID NO: 23095 - protein, 61 aa, Candida albicans
KGSPYIINSSEAMFPLYLCGLDNFATVLYHQYNSNKAAFGWLNNYMMNSYTLKVTNKWKTK

SEQ ID NO: 23096 - protein, 205 aa, Candida albicans
VPINFSSLSSENSNTLVLARRKSFALRSIPIFMPNTLIGSLYYGKGLDNIQFKPLNNTSTLQSIPLLASNIFRNWVELNYKLNFIYHVPILTTPGVDSKRFNFGFFESNKIENNWNKYISIQEEYNYNYDSRVFIRHAIDNALGHVSLMINGSKLLRWKFNQINLSGKETAIADKIWWKFILLSRVMKEDVFSNMIRKFDSFFRY

SEQ ID NO: 23097 - protein, 385 aa, Candida albicans
DLPYILCHSVLPTIQPQSPSNDFSTQYSINSSIMSSPDAPFWKYHILKFGKDLYLTTNPGMKHVYCRNAPGYFIEVVSSDPITIKPTPTSGYSLIFRDSTDLTENSRVPFMVITKKPASEGGEFTFFIPKDKFLNQGTVVKYEDLTTYNGVSFTKRIDEAFFPYTGLRTKYPQYFQNHEIRDLNNVPWNIGSIPRVRSSKMTKIKETFKSTSPSKSKTHPTATHDEEFKFIGKRNIYFHQNYVSTAHHGLKYREFEPRFIYGHDYGQSFPPVLAMFRPFETRTKKKIIRTVKNNKHYLNGSLNENPFLENVDDQYGTETKKFYQGSDGLYYLNNTSDDLPDENKLGWITIYEDLEIFGGIRNRGMFDIVVGMTLAVGYDSCLSNE

SEQ ID NO: 23098 - protein, 60 aa, Candida albicans
FYFFFLQLIINSKILVILLGVLNILLYVEGVLVYIWFDLIYNVKKLYWFLVEEGLRIHLA

SEQ ID NO: 23099 - protein, 68 aa, Candida albicans
TFWLNYLQIFAAKKKNDSLPKTKPQHSNNCTGIEIIKYCKFISLFTYNIAINSVNGFVLKSRAGLSMI

SEQ ID NO: 23100 - protein, 93 aa, Candida albicans
MIMVYYPNMKSTVSPSVMYSKNNGDYKKYQFSSQSTRELDYHKVEKFFDSVDQDNGTWEIVKESLIDTETLSHQQQEVDYEDDDDLAFEHIEL

SEQ ID NO: 23101 - protein, 84 aa, Candida albicans
PRQKAYIIISPLYTSHLCRTINIIITLLHYYSLLECLIVKLLTYSRRVIISKKKYNDFILYKSILFYIGRRCDNSKGVFKLLDS

SEQ ID NO: 23102 - protein, 69 aa, Candida albicans
IMIPTVHIYISIYHILLVNCVSVLYFTKYLHIVCLNITSLSIVTWFELEIGNLLIKTKEKKTPPTAPTN

SEQ ID NO: 23103 - protein, 77 aa, Candida albicans
ANSHGKTHPGDCNPNKIKRCCQHWGGVFPGKLLWLGMTLMPMNMGDGIQRADCRFQGLWYVQRTRDLGCCCCSKLVR

SEQ ID NO: 23104 - protein, 64 aa, Candida albicans
NQKVLSTLGGGISGEIVVAGYDANAHEYGGWNTKSRLSIPGFMVCSENQRSWMLLLLQTCTVIF

SEQ ID NO: 23105 - protein, 79 aa, Candida albicans
CICNNNNINNNNNYSATSLSIYPHLQENTTPPPPSPLMHTCSILLMWDNLFLYSNILCFFVSIFEFLDIHLMMMTIIFF

SEQ ID NO: 23106 - protein, 219 aa, Candida albicans
NGRTKPGKKFVAKKRSWVWTWFDQDLHDTNIAKCTYCNKVIIRFASDKGSPKKLLEHLKTHKININSINFARPVPIDGTGMTYSSSGQPLSQPLHNGIKKEPGSNQTHTSQLSDLSLQLASSRDTDNKESLNGTSGPGQPFNSSRFRINVVKFLTENKLSMDVLKSNSFRQLVYDLRPESVNDILEVTSMYDAFLECTRYSPVEPGNTDSNLRVNGSNT

SEQ ID NO: 23107 - protein, 77 aa, Candida albicans
RYVLLTKESKRASNTDSTNFLNLYIQCALHEKIFQSRAVLPFMFLVLINLSAITISLRYTSNQHHCNNMLIKSTVIF

SEQ ID NO: 23108 - protein, 69 aa, Candida albicans
SFQPRGEESLITKLQSTLTCVYKTEIYIYKKTMNTNKKVAKINVIILEYRFKSLLTLNLLILIIQNEYS

SEQ ID NO: 23109 - protein, 64 aa, Candida albicans
IIKIKRLRVNKLLNLYSSMITFILATFLFVFIVFLYIYISVLYTHVNVLCSLVIRDSSPRGWKD

SEQ ID NO: 23110 - protein, 72 aa, Candida albicans
INQNLIFSVSFRNIPKMNILVYKIYLQHVKALLIWFFIISFIYLLYYIVITIHVYIYIYNLYEKLLYNFIFS

SEQ ID NO: 23111 - protein, 61 aa, Candida albicans
RSRFVGAVIIVLTEPKLKRAKIESKEPIFLYSDIGEVIMCILFFSSLNLSCYNYILSVHFF

SEQ ID NO: 23112 - protein, 64 aa, Candida albicans
YLILQYYVDFEFIIFLGERKKEKSIFHKLHNRVINVSYVVRSEERSELMIIRRRTNVGKYLYNI

SEQ ID NO: 23113 - protein, 76 aa, Candida albicans
VKSKDIIIERRTKKKRKLIEDCYIVNRNKTKKKKVTKETKISIEFKYVYLVYCFINWVVLVISKYSCFMIVSERTY

SEQ ID NO: 23114 - protein, 70 aa, Candida albicans
VHILSSLRDKIGVNAAMSLEKKKLLYIACIARPDTKNLCRMKYWIRDIALNYRFTRKKKKKICCKKRLVE

SEQ ID NO: 23115 - protein, 106 aa, Candida albicans
HSFTGKNTCVSATLWDNNNNVLEQNQMINDHNSSEFGGVKKNYVPFKLLGFGVCFQWMIVSSFGEDRCKKLEKKYLLFGTISIKNPCKSKYDIHQELKNPFSILLP

SEQ ID NO: 23116 - protein, 114 aa, Candida albicans
  UNSURE (37),(38),(51): Identity of amino acid sequences at the above locations are unknown.
FLEDQESKGIGNEPRKVRTTNRRATPHQQAAEQEPPXXDQQKQGHTPPPHXHHHLHSPHHHHHHYYHHHHHHRLDNSSEFTPVANTTNGSTKRKNDETEPLKPHRQLFKKTILN

SEQ ID NO: 23117 - protein, 81 aa, Candida albicans
ILIIMTKKYSSTDLKLSKLLHRDLNSPPIVIDHANGNNLFTQDHHQLFDSVGGAAVISVGHNNKEVIDAMIFHHGARRIRA

SEQ ID NO: 23118 - protein, 552 aa, Candida albicans
TQEYVHILGKLQENDKYNTEDQASSNTPLKEETQEEEIIPQQHSCDISEEPQPEEQPQVQEPFFNHSNPPDLKKMISISNLKLKPMRCTSATSPTISKKKSRYRLSSIYNINPIAYEESTMETSVATSSTSSGEHTITSDSHEVDHSRMQNSVTYSYETLDSHIMNGTTELHGNMTPVKISPEDTETPLNEVKATTRGRSNSLPTTSTKDNSVPDNDFLKEFDCEDDILRLNRLKHFISVSNLPGIHYYDHDYQDDTGSDYNHKDDVFFDEIYTQSPSPQARRNNINDGNYDVVSIVSDFSYYSPEKQEHQLLGTDNDDIFDYNDFSDFLRKSRLDLNKDLQQAFPHLMPAPQVKETQRYKFHNPIEKQLTSSMISTATLDVQASAILNNKIDPNNNKLSYRPGATSTSITNSAFASSSPSASSILHSYMQNPKTTTQQSNESTHSFSFNDGFFKLYHSISDTPKKTSITPPKIKELKKSKMIKSNPILIPNEAQLKRIPPSRTDGSVSKLIIGSNQTKTIRHGDGSIFKNPVAKSYDYSALRDALASSILD

SEQ ID NO: 23119 - protein, 96 aa, Candida albicans
MRIYPVFKKPSIVNSFNSFQEQRCFVIKDGTHHFSGVTIIRQYKVVAESKASITYMSKNNNHNKNQIKNIQEEKIQKSLHLSRREYSSFIDDSGFE

SEQ ID NO: 23120 - protein, 72 aa, Candida albicans
  UNSURE (66): Identity of amino acid sequences at the above locations are unknown.
SSIYKIRENRARTDSDQNKLYFMKYQCQTTKLPIYIRRIIHCHYLLCLKATSSGSSNDTQNMGFVXETILTS

SEQ ID NO: 23121 - protein, 120 aa, Candida albicans
TLFLMIHSSLYLFNEMINYWPGWTYIKHNLSQILTSSNDNGNDNGNDNGNGNGTRSLSIGDKLLLLWNTPQLIIGGLIGLWWFMLLMTNIYFHLSLEKLVRLGFGYIGVARLYWIPRWLL

SEQ ID NO: 23122 - protein, 63 aa, Candida albicans
TVNFKELTKSFLYIGFTPPKNGYLIKTNNKLSGKRISAITALKEIIINSVRSVLMNSIEVLIN

SEQ ID NO: 23123 - protein, 73 aa, Candida albicans
NDDDLVKSGEYIKIAIDRFKQNSDLVMLKQCLQYQVYLMNKYNQPQEMELANRLLNEITQELQNEVEQGYIYN

SEQ ID NO: 23124 - protein, 131 aa, Candida albicans
TKVMFKLLIPNKYNYVIRPLVRFKSIKSPKSPKPKPTAKLSPNVFSLGKFSQLHNDTSTTNIESKITSFDQLKIFPSVIESIIKEIKSHYYLKRPRHSNIDEIDIKPTPVQIAAIRKINQTMKLIVPNKDL

SEQ ID NO: 23125 - protein, 127 aa, Candida albicans
NLVTFLPLFIRFFKMSTISADALLNETKRERNERFKNQLYQAAAKGVLQGTLIALMTGYALSYKYNHGVNRAYFKTTYKVWWFVGWNVVGITFATDTAKMKISKQAAMEDELKRNRYIEQELSRNLK

SEQ ID NO: 23126 - protein, 62 aa, Candida albicans
FQFILGKERESLLYFSTGLLQLSIILIIRGSLSSLKIIKIKEPPTITHKLTKLKQISLKIYL

SEQ ID NO: 23127 - protein, 82 aa, Candida albicans
KNNQFIRDIVSCTASSYFILSVSCKNCIVANEIVIRETAILPTTMVSSNDEWCTSQDYVSLNTKKKERPIIVCMEASETKQK

SEQ ID NO: 23128 - protein, 67 aa, Candida albicans
IPQGNPQFTTRIIPISSSASLISHSYNHHMFKKGLPLVGRFPPQGFPFYHPWGVLHKRNFPPGDKET

SEQ ID NO: 23129 - protein, 66 aa, Candida albicans
LKSASDSEPHKIIKPNYNRAVFKLPFVEDLMGKKKPRSKPKPKSWTSFQYWLYHCFHQGVTLKFRQ

SEQ ID NO: 23130 - protein, 73 aa, Candida albicans
  UNSURE (47): Identity of amino acid sequences at the above locations are unknown.
LFPPPPNLFRGAPNFPPLSPKHRILDPSITLASLYDDLKKYKPYIHXHTPGDLRESDYHSQKTHTSRIYPHLQ

SEQ ID NO: 23131 - protein, 470 aa, Candida albicans
TKRDPGLSTSLSVINPTLESEIKPNPVILNQLSFHPPPNLNTGVLYPPTATAATTTTSSPTNHHLHPYFVSLIPNPQHHPMLDTSQHQETTSTDPNQFDYSHLSMPQSTPLLMKYDITTYVRLIETEKYYMLLDLANELDIWKKIIPSLCLQISENDSFLLDCLMSCSRNTSVNLLDLTNEQLNKWSQLKNAPVISERIQQFEHILISIVLILLGLYLNTTKVRLTDYHKVIFNNQAKLFSHVLRKIHTFITSNKPNSAVLTNAIQSITMLKFFIDKNYDFSYEFKNIQKGRVTDTLEEITYSNSNLYSNPDISYISTFNEYEIIYLNNSYQNLVHVDQSNSMLMGESQLYKDLLWYLMKVDFVINYPEAANNLVLDHNVVYQQITNASTDLSFSNNLNYLNPRSYANYFLKEFIIKVLSMGSNAIIEDANNRINTLFNFIDQSYMDPELKSQFHHCFTWTVRYIHPVSD

SEQ ID NO: 23132 - protein, 111 aa, Candida albicans
IIIVLNVCLYYPKVENFEKLSLFKNQIYVCRIYRGKYMKTSTALMTGFEQEIITLVGTSLNLHLAKNLSSYVAELTFKYDQDLNTKQIHVTKIFRSAVLRISFTFQIEISY

SEQ ID NO: 23133 - protein, 61 aa, Candida albicans
ISIKHGNLSSSLFSNLMMMMPFNVKLATLHTGKVEEKENKDYLNDLHAESKGTKKFYLFHQ

SEQ ID NO: 23134 - protein, 98 aa, Candida albicans
IFFLTYFSIKKVLKISINSQLNPYYQLWNNQKKKKKERKITGITFSTENNNNFFLFIPRYNKNVRNNIKLSPKLPSTCVDNQSTPPLTRTIEPQHLFL

SEQ ID NO: 23135 - protein, 76 aa, Candida albicans
STPKIGIQKNVLGGREEEGGKEKSREEFGYFTCILSRCGGGTYTSKHEGRKINLKKCINLDLDMDIETKKDKQQMT

SEQ ID NO: 23136 - protein, 84 aa, Candida albicans
IVNLHTHILIQLTISRSPPPPRISQANLVLSVVSLNRYYKLYYNKDGRNYSIVVHNSNPPSTTIVVVLAFTKKKKNVLLFIIYY

SEQ ID NO: 23137 - protein, 635 aa, Candida albicans
TYNVCATSNKDKSSSSTTLPSSSSYEEISYYSLKLLTSNLFIKNFQFCVGKILAFLKMFTQITQTWLEEKEEVNDQSSCVKYESECLKEFLCITLLLLLKIKNSEDESTLDGNDSIISSDSASTNATTTTTDGLKLIEVDYLFQTLRQYHMMSIMSEFINTEIMAIDKHKSKFVILKFSCDIIFEYFYRVEILSDIQLSELINDSNNNKNLISTLVQYLLHNENFNNYDLYADDFNNEDKLIAYEELKLLLLINEQFLMKSFNTNNKNLVFDELMMGNITNGNLNNITGFINLLIYHLNREESHIIKILILKFLYLVFTSSSTCKLIYLNDLKILIDILLRELNDLDYNENIVLTMTYLRVLYPILMFSELCEINGNRNRNGYGHGYKSQEILETLRNIIINSEIKSVETEEELSISKLAVKCMNVKWLKKLVQNQDSKQGMVIPSTKSTTTKSLPTQNSNSPEEEDEEDEKIKLNEEINTSKESLTNSFTRVASVRASSRSDYHKHTTVHNIERKNSMKSSSTNSKTNNSNDHDDSNDMIMENNGNIFLSKFSKMSINDNSNRGSRQLTNNTSMSDSLLYNSRKNTQSERTNNNNNSNQNNRDNHNILDLPTEYLISKPLPKLPIPEKRHLHRA

SEQ ID NO: 23138 - protein, 165 aa, Candida albicans
ELMPKIIILLISRHSITSNSSTSNSKNSTFWSINAYVDESNDLLTVATHNKNESSTFETESTGFAIENGYLSYKNSTHFLACPTSSSLTTTNDTIVGGNGNNFTNSSINGDAGFEIYANPKGKTTCPKGIEGYDIKLLTELIVTYSYSEKFNSNGFFKRQLSKDL

SEQ ID NO: 23139 - protein, 108 aa, Candida albicans
RVFKIIYTMRESYKICWILQIIRNCLAILQTLDQIELIFMKNERQFKIVLNWEIVIGDPLTGTCNSRIQLYIIDILDNTTKNLSQVFENLLLQYDISTSLTTIIKTIF

SEQ ID NO: 23140 - protein, 299 aa, Candida albicans
  UNSURE (252): Identity of amino acid sequences at the above locations are unknown.
AIVCPAASFEYNSNCEVQTLSDVLQTSSPSNQSSRQLQSTGGGTAALNLAEAKIVTHEDKLIQLQSLKIQLSEQRDQLIKSRTSSTNELNDLRLRHHQLTQELSKTRKETNIKNLLDSNTSQYIKNLEVKNLKNDDYILNNLNVLPSTDWDLRLTYIKRFVPYLEIDKIRTFNECDSEGSMIRIIEFQLILPLIFQINFRLLVNCENDSLKGIEIDDLFKISMISNSFYQMVIKNYIPNKKISTLMFGLNSXSKLLHKRMSTINKLVKSFQDNLYDAGKLQDLLDTSDNKKLFGHFTNP

SEQ ID NO: 23141 - protein, 212 aa, Candida albicans
RQLLFLLSNAVHGVPFLTDQKNSYLLDFFVNTKIHPANRAKRLLWLLYTLLETNFTETDLHNNPFGADSIPSIQWLDDSEMKKFDIDPDYERYYAEEMFKARMQYLANPDDEQYKEHSRRSHGYGHLKKRDAEDHDDTSGGEEVDDRKKKSVPLKKKLKRNNPNKPSPLSKNVITFHDKRNRDIKSGDILNFDLEVSIHFPGKRFERIGIKI

SEQ ID NO: 23142 - protein, 219 aa, Candida albicans
ILISKLVFISPVKDLKELASRYKSSDIMNQSPNELESVRHPRDIVELSKPMVQEVRTSSKASTASFHKKITILGNWLYRYFKYKKSIGNRLVGIEWEDIRYDLVHGVESYLYEKFGKSLILDKMLSTHYTGAEGTNGSDKNGVVANGGNTTGRFEEEENEVYFDYVPLRDYDKANEKQSFILHLISFVNDWFILRLRKNASLTQVNRILIDLDNETVHM

SEQ ID NO: 23143 - protein, 111 aa, Candida albicans
IGWYIFKDLEVIVFTALHVAKNLDTHFDKVHISVNDLPEEIPDPVMYDFFINYLPASIQESEGVKEEAKAEVKLLTDAAHSIRVLPMVRKFGSQKSEFDLDWIADGMWCWG

SEQ ID NO: 23144 - protein, 173 aa, Candida albicans
MTPQFPPLFLYPLFYFHLVYSFFYFIMISTLSSSSSSPLTTSTHKLENPIESQRKRYKHNMQSMSSNTHHPHFQLSKDNENNNNHHHQHQQQHEPKYISTGTSLHNTNNGTFTPITQTHSHEYLMMMGEETIINNNNNKLDIEMITEDKFFQPQQHIEKPKYEVFTTRAKDRT

SEQ ID NO: 23145 - protein, 79 aa, Candida albicans
VKKNVFLQILLLLCRLRCLQKEKKKVDMKEKKKTAQKNPLCILNQGQKKKKLTPVAQFSLTKIDYLIHHSIVIIYNAQA

SEQ ID NO: 23146 - protein, 61 aa, Candida albicans
TRPIKDLSSECGWWSMRECVYQPERETKKEQQQQVTKTQSDNLYYLNEKQKEKKLKYKPIR

SEQ ID NO: 23147 - protein, 67 aa, Candida albicans
KINRTFFFSIGRVSESCRKCFNMQALVKYSTFALVITNKKTKLLNVRGASESNKPVTCIKIVLGLQP

SEQ ID NO: 23148 - protein, 63 aa, Candida albicans
FFLVLGAEEFLEFHDLSTGTDQEKIQKLGFSSSPPGELRLQGAFRILNTWPNVVLHCLNLNVH

SEQ ID NO: 23149 - protein, 71 aa, Candida albicans
DKKIRQGIIIAQTLVSFFVLVGAQKSFNCILCVCCPCFSSSDWLIYDLALQKRITGGSVKNLELTSVIKKS

SEQ ID NO: 23150 - protein, 61 aa, Candida albicans
NFSQKICATSCIVQLVLVIIVQYSINKNTKSNLIGLFIFIWLVGVMPKLLLIPLLVNTLLL

SEQ ID NO: 23151 - protein, 158 aa, Candida albicans
TLFQRPTVQALVLNSLQKGNSGANTLTTKTTGTTTSGSGSTSVPATSYINLTGKSGCLISNGKYYTSGTCATYHFNTGSSGNTQITSSKGNCGIDSSNQFTCSSSTSATDFQVSGGSIGYNGNFDWCLGAVTGSGSTAQTSVKLSDGSCSSFKLTLSS

SEQ ID NO: 23152 - protein, 78 aa, Candida albicans
QSIKMRIYLGKELKQIHLELLKLFTYWKGQKKLQAQEVEEEDDDPGVMETSKKPFYEVWKKCFLQQLEAPLIPILTRI

SEQ ID NO: 23153 - protein, 81 aa, Candida albicans
NKNACLNKLFFSTKKKNQLKHNNSFSLPTMSDEEIDDLFGEETTEKIVDLSLPRHAVVLVMEKDVRVFEDTRLFKHRSTPI

SEQ ID NO: 23154 - protein, 63 aa, Candida albicans
NSMMLLGLACYIFSLRTMYVRVIVCIFTLKFFFSRLYSFLIRTRYVSSTFWLQFYGRVIIYNL

SEQ ID NO: 23155 - protein, 66 aa, Candida albicans
PNIEEELLLFIICLFVEFMRFNSYAAKLKKKTKIAHKSWPIRKKNYLRDPPKKSYAGESYKPCPKI

SEQ ID NO: 23156 - protein, 64 aa, Candida albicans
  UNSURE (9),(13),(14),(46),(47): Identity of amino acid sequences at the above locations are unknown.
LNCKMYENXIAFXXYYSFGNTSAKKKKMSIYFGSCVEIKCRFDGPXXRNNTLILNYLPSLLIHT

SEQ ID NO: 23157 - protein, 186 aa, Candida albicans
TICIYIYFLRKQTTHVFLISSPSHHLNSSTQPPLFFTSTFWNMFQHLNIIATTQQLQHNTPTMLLSQYQTYQLFINQLISIFASFESLLCKVSNRIIFIIWFPIILFFIFDIVSCLSVKLLLNYNLLDNGGATTATHHASNGCGCGYSYGHFHRILIIPTNQLKEVQFLFKVKVFFHLYLEYYFYN

SEQ ID NO: 23158 - protein, 107 aa, Candida albicans
TAYDVKIGYKSLSLQGMIFFFLVLFSYDVNIICIQYTIIYYYLLFVIKTIEQYNRKPKKIPDPTKPAPASPTDQLPLPRLLLFPSLSSNLTRMRPLKECNYVQEQEN

SEQ ID NO: 23159 - protein, 92 aa, Candida albicans
RFGNTQKNIVNVRHFEGDISISVAIKFGRKERRKKSRIGNCIDKLGSLFSLYTFWTKLWRSRNYFPLLFATKRSKSSLGAGQNSIYRAVHTN

SEQ ID NO: 23160 - protein, 62 aa, Candida albicans
YSHHKKTTLRKKKSFPEEREIYSQFLHHKLFKLVFFFIFKTTIQSIQSINSNNIPIVILIKL

SEQ ID NO: 23161 - protein, 72 aa, Candida albicans
NYILIIIESILFLKYLCLTVFYFLHISNTRSISAIYTSHTPVQDIRSASYNSHKSISIISLVYQLPIHSHSY

SEQ ID NO: 23162 - protein, 93 aa, Candida albicans
TQTKKNKGFFSSVLFISVNSNSNWFYGLAIYLDSLHKLHNIQQSTAKMLIYLLTYNSENVICDFYYVQLLLVLINMDKFHLVFTSRGRSMSRE

SEQ ID NO: 23163 - protein, 87 aa, Candida albicans
EQEFYSFKETGILSNNLTKDKLMKVLYNDIIYWTKNNNIDQKSDRISEERTREQGRATFYYLDIPKKLKMANRCLLNFQNGLVVVND

SEQ ID NO: 23164 - protein, 133 aa, Candida albicans
HPIKMKFTTIAAAAFIACSVEATFLPLLKLGGGWKGGNNEPPCDTPAPPPPPPPPAQTTPCDTPPAPPAPTTPCDTPPAETTPCDTPPAQPTPCETEGGSRGNGGSGGYGGGGIIGSIIGKKVKFIEGLLGGH

SEQ ID NO: 23165 - protein, 61 aa, Candida albicans
IMWAFSSLVTYGNGTDNDSDNDSDNDSGDNSDDDCDDGNGTDNDSDNDSDNDSGDNSDDDC

SEQ ID NO: 23166 - protein, 110 aa, Candida albicans
WKRKKRMKIEKSFDRDEMRNHISNCGQFDWDTESGETTREDNPNVTNLLKHPENKELTVKDHAAPMSEYNYINESLILFSSNIVNKLKDIEYNVVEKRNEYQKRIGFGVF

SEQ ID NO: 23167 - protein, 66 aa, Candida albicans
NFHGYCQNLGDSMSDHINNHFMKFQECVLDPVYPDVGQNGSGIMEGFKLKAEGGTDCDSRGDRSEI

SEQ ID NO: 23168 - protein, 83 aa, Candida albicans
CESQRERERGKGSAKFTKIVNLLSCNYLIYQRSPQILYRGIVLVRYYLISIYKKKMMPNDYSLLVLVPVSLVSSSGNPVDSFQ

SEQ ID NO: 23169 - protein, 63 aa, Candida albicans
CSTAVENWPLRQQTIYTFSPHYEITMKAVEENIKKRKKKGIFNLSSSFFYSSVLVFYFILFSL

SEQ ID NO: 23170 - protein, 65 aa, Candida albicans
SSHCKLEFLESIEQLKCIKKYYLKLEEETKETIESCQLDYQKRKPKIPALKPIKNNHWASFFSCK

SEQ ID NO: 23171 - protein, 97 aa, Candida albicans
CTCLFSTPNILGNDGPVRSISKTPTLNPLLTNVNATCVVTEDFPTPPLPDKIKIICLTCSMDLGTSCNNSDDMSVKNNISNNTIEYINREMGRKANR

SEQ ID NO: 23172 - protein, 62 aa, Candida albicans
GRVRSSLLYRHSLVFSYIFFKPNNYTFFFVSTLMLSIIEQCCFFYSILMRLDTVYLDRDNLQ

SEQ ID NO: 23173 - protein, 112 aa, Candida albicans
PVFMSELDQLDVKLVDQDELETSITNKANKVLLLKDAELDEKRLSKAIKELESTQRQIANLSARLAHPRTKISEKKRLKDEIHWYEENELIPRQQDVDDIRNTLKENILNQP

SEQ ID NO: 23174 - protein, 61 aa, Candida albicans
LRPGTTNETSKDAMSHYHLRRVLELLSCYGFVQYIDYFQCDYTKENNQRSGNSIRDLIQYL

SEQ ID NO: 23175 - protein, 88 aa, Candida albicans
RQIKPTIKNLIISNDSITTSYEPMSYTISFNKDNSNSLNNAKTKKQQQKTDKTIKTGKENTTITTTTTVVGGGSGGGKKFIPDDNFTN

SEQ ID NO: 23176 - protein, 73 aa, Candida albicans
FCVCRAVRTTLPVKIDFFFLLVRIFCRSLLNFLFVPLDGEQKKKSDFYSQPINSTESEPERGRKKKALNGSWV

SEQ ID NO: 23177 - protein, 62 aa, Candida albicans
QDKIRWTTFGTLPIKISYFSVQSLQKRKTAVHFIDYHGFIFLTSFFFDEKTIDLRQTKKIHG

SEQ ID NO: 23178 - protein, 71 aa, Candida albicans
KNNRFETNKENTRVKTILYNAYGLSQMWISFSWVNCIYKYGEFGVRINSEPKTITTINTFKDKKKIIQQLH

SEQ ID NO: 23179 - protein, 63 aa, Candida albicans
QVRKCGWNYKSVYGSTIGNIRVGFHKAKCGIVLDDQQHVTTVNQMAVEKAPREYNSSLLETNF

SEQ ID NO: 23180 - protein, 165 aa, Candida albicans
RISTQPASTTSMQQSQSLQTSQQSLQSQQSQQSQQSEQSQPSQSPTSTSQAPVSTMSDNNTSFVSPSDTSLLVSATTTSSSSTSSSSSSLTPSTSDVTTSSSASSSTSSTTSSSSSTAFSSSTTETSSSGTSSSSTTSSSILSTQLNTSLSSNTSFASSTTASSS

SEQ ID NO: 23181 - protein, 94 aa, Candida albicans
VDSILEDVVELELVPDDEVSVVELENAVDELEDVVELVLLLALLLVVTSLVLGVRDDELDEVELEDVVVAETSKLVSLGETNEVLLSDIVDTGA

SEQ ID NO: 23182 - protein, 389 aa, Candida albicans
FEVLEISFIQGKIFTNDALPIELSIQEIIIYLTNQFSDQNNNNNNNNNNNNNNHKPNINKLISLYEKFRFSNQLINQRELIEFMIEFDKFGQMCQNDYQIKFPRSISHSRNNSTNKLRKLSRLGGKFSGFDLSDYSSAALFDDDDDEEEEEEEGVDYNQEYNSEYDDDYKEEEDYDDNSSSNNNPFQHYKVESKYFEKAVTNSDDNDNNNDNLENSSSLNIRGLHHQSSFSSTKSVIRNKLALGNRPSLLKYDSHTSGNTRNKKQRQKRNEVGNNSDDNDDDEYYQLLRKQSGYITDSENEGYELNSINNEEEEEEEDEEEEEEEEEGYDQDDQDDDDEEQFYQFRRGQRTVPEITINQELNQQQERRSSNADSIKHLSPTSSIKRYFN

SEQ ID NO: 23183 - protein, 65 aa, Candida albicans
RPNMNRNVFPITKQSNGDLINQINESINCGGSGIVGEGTLLPPNIHYEDVIRSFGDKFYTGENIH

SEQ ID NO: 23184 - protein, 85 aa, Candida albicans
HQTFISYKQYQKVFQLIELFCVLFTNGNDSHKQITLVFNCRVKNNNIYLILSRFCNSIMNKIINNSAIIINHGNNFFNAPGKEHV

SEQ ID NO: 23185 - protein, 67 aa, Candida albicans
PKKKESKCSTKAANVKRVKCIKWDKTNLHKIKAKNLKMQKPKINHKTKKNGNRRMNTFCVILRKDPF

SEQ ID NO: 23186 - protein, 72 aa, Candida albicans
SQQLLILTRSTDREGSRVKSGCKPILLHVCVLSNYCLTKISILNLKPKSLNYRCKQNLKFTILLQYKLYRNN

SEQ ID NO: 23187 - protein, 556 aa, Candida albicans
VTSETSFDKVQQFTEMSNLLLQFVLNILPQENTFENLSLTIFIFHNFLVSLKKLQDSLEISGMDSKFIQLISQTSLLFDLLTKVSSFMNSLYLRHVSYLTEESGLSLIIRKKLELDTHNKEVFQLFTPEFVNLMDHDIDKYINIISKYQESQTTGDAISSLNAWFDKCGKYLKIVKPDSKNISISKLDVYKCIPHLHTTLSNISWGEFALKNIDEEFAHLSTTMGDLLWQQITQFVDFMSNAHAELKSPEKLVYVIGIINQLKVKISSLEIPTTTATDDTKEIVNKLSNLLFSKLIESVPSDDFYLLVDESIQESVTIETVDIPVRPTLKLVRALYKLSSNYLSVAQNSNNSNIFLEAQVTEDFIKCKNKWVEKNLIGEVFLNGIEKSIKKKKEKSLKSTAVDGKESPDRALEKETTQSDSAKIKTKEENEAEQTTKEKSEKESKEKTEDDGVIKTDEANVNSLDQAEEKIDEPQSESKEKEPELNEEDDDNGKTEIVNGTTSITKTQALSIIANYTFLLHFLNSKVDLEDIESVTQLIKTHYRAVFTSELDKSAL

SEQ ID NO: 23188 - protein, 63 aa, Candida albicans
KIFGDIMLPAAYITNQIPLAIVFFEDPDTLAFDRIQHKITGPPIINCKNEHPTRAHLCVNGMT

SEQ ID NO: 23189 - protein, 92 aa, Candida albicans
RPIRPGKGGIQMTNNTMQRMFLTVKTTIPAATTTTNSTAPRGICNAVAWIPVNPNPLINEEAKFDVPPLITPHARPIKATKYTNKSCNASTA

SEQ ID NO: 23190 - protein, 186 aa, Candida albicans
FPLVSHLHMSANLNQVSLQQKIASQINLNELLRDLNGTPSSTTDFINQYNNFKVPDTLISTNSNPITQHQADDEEEDVIDNEEDDAEDDQDQFFSIVPQNQHGHKFANLQAPQPVSNTGSNTLNNGPVTTATPSGAIGGGGNNTGSFLSLFNATNFVDDQTDGNNGATGVGSSFFNLYQLNNLPEK

SEQ ID NO: 23191 - protein, 106 aa, Candida albicans
TLISTSVEDDDNVSIKFHREGSSSEIVLNFPKIFWTSSDVAPAKTNQGGATGLIYGSLTANKSDFYVLSTPNSKIPQDLAITINCLTNLNHSKTTPRCNHHNKSTI

SEQ ID NO: 23192 - protein, 243 aa, Candida albicans
KKGTLFVNLAMIVEVHSDVLLHVSDLFARGVENKLGLLLGYGLDDRLVVVKPIELAQVDPQYLEKRYSLFKDVYPNLSIVGVYEIGGNNPDRANILDIPAGRILYVSVDHNIQFKSFIDGDLVKTVIESSETEVIATKTIDTNKEYTKGRPKDELTVAEFNQNMVNTLTKLYERLTKILETKGMDKEIVEIANALRCYKHVKQSTDMKLQAAELALITEQIVELERTKIGIAKKILVKEPGLV

SEQ ID NO: 23193 - protein, 60 aa, Candida albicans
  UNSURE (26),(29),(41): Identity of amino acid sequences at the above locations are unknown.
KRFYSDFKLVNIQVVLSGKLVNLSEXISXRPSFEFFQLFCXVSKMVVNFSNQNNLFSITI

SEQ ID NO: 23194 - protein, 162 aa, Candida albicans
LVLYNYLIIQTKMGWFSFSSSNKDSSVSTVSLPSQQIEQRSHQSLNLPQGSDIATTLNQLSSQTGNDQEVKVKEIDNIQDKNEIEKTVESFVESYPISNMFVIDGEKDSTQSIICTTTDSGKTCLKLKMNSIQLFKIMQKQEYFCSLPDDINATYFECRKIK

SEQ ID NO: 23195 - protein, 103 aa, Candida albicans
QIMTILSTDVDLFSEAAKLPSEVITIIVDHLPKCILPELLHFPPIRREIASTILSDVYITENVQRHKGSDELLVGHSLCDCSHFKIKLIKLKQGSSPRNGDTR

SEQ ID NO: 23196 - protein, 75 aa, Candida albicans
IMPPKPLVPRTLHIPGVKRNGDLLYYIGDNGITFHPNLTIDRSLLGGIGLFFNPGEGGGNESTQTPQGTIVNSNV

SEQ ID NO: 23197 - protein, 313 aa, Candida albicans
RSNVQMMANEKFEVTISYDPEDNIKEFLYTYGFFPKIVNNNIGVSANFNENDNIQLFELKLNNLDRYIPKSQYLCRWLKVLPQIQLVIKYASSDTVDNANSNNESNMRVYFNFFSNNLPLLFIPEIAYNAGWLDVLIPHFIKYNNIPPNCRTNIDALELVNMFIYQEKHCDYINGIDPIGVKLTTTDDDNVGSSRKAPVLLSDLSNILQVTNSDFEDLIKKTLEFIVTVYLNEQVEHLKDQLDLKKKLVMCGLANNFDELVDKYQRFKFRVFQQIIKQYKEDLSSLILPESIAKRAWETKYRTPPREFIFECT

SEQ ID NO: 23198 - protein, 93 aa, Candida albicans
LVGSIIIMKRSYTSNGGGEAAGAGQVEEMWDFLIEIVQIMLAVINSMIYHLIWGLIVSRMYVFFIFGTLITVFEPWERLIGPIISVINTNNVY

SEQ ID NO: 23199 - protein, 112 aa, Candida albicans
  UNSURE (99),(104): Identity of amino acid sequences at the above locations are unknown.
KLDELQNVLHKLQSRQLKVIPPPVMIAVMMVVKVVVMIAVKVVVMIVVLVTAPATAAPVTAAQVRKVPAMKVVRFIMHVNLIRQRVHLDVALFIIYYSXDLSSXTGLEGTEL

SEQ ID NO: 23200 - protein, 699 aa, Candida albicans
  UNSURE (487),(699): Identity of amino acid sequences at the above locations are unknown.
RQLLNDSFAGKIKRSKYTPHTSANASIVNGTGSLSNNTPQSNTPVPKDNPVNNPNVPTTSVDNSHQTGKLGMLKSLIDLHPPTSTKPIASGFSFSLPKNTKLSRNFDGSDESSEESTSSITSDDGDQSETVTTTSRIDDIDSLEKRGASNQTQPSEPNVRRVSETSDAPNNNVSVNVNETQMGPEKEHEPLPEGKTEVYGEGEVEITEKTETETETEVNAEDKMEVESEQVESEDEVEADDESESESESESESESESDSGSEYVDESSEISSFKNERRAIRNVRRPPAIISDSSASSSDEEVVDNPRAPVIDTDDSSSNSDEEVVDVPKASTKVSDDSSSNSNEEIASNLTKKSDGSSSGSDEEIVDKPQSPTRVSDHSSSGSDGEIVDNPETPAMDIDDSSSGSDEEIFDKPQSPKRVSDQASSSSNQEIVDNPETATKISESSSSEEEIANNPETPTMDIDESSSSSGEEMASNTSKVSDGSASXNDKEVANNPTKVSDGLASSNDEEISNNPETLTKVSEDSSSSSDEEASDSAVMLDGTSSGSDTESSTNPETPPKLNQKQPIANAGGDKNVSNKSEIMVAPLPIATPRVQGLALTPTASTRRAKMVLSKEFVLDSDDITDDGSNANDGIEKDKDDVNLKSIPVKKANDPTVSMSEKVPQPDSKDSLSESSDDSESSESGSGSDSSESSDDSDSX

SEQ ID NO: 23201 - protein, 241 aa, Candida albicans
  UNSURE (27): Identity of amino acid sequences at the above locations are unknown.
VNQVTILSPVNLGQDLILVSQVTILIXSESGSGSDSDSSDESMDSSDEESSESSSSDESPAVKKPELKTTGSKEKPQPVKVQKTPKPIAFSIGEPKKVPVPAPAPKTTQRLASLKDLKHPRTTIEMKKPILLLPTKPKKKFSRIFDSSDDDSSESESDSDSEVPMSQLKVGRAPKRSTQATKPPVKSDTSSSDDSSDDGSEGSSDDSSKGSSDDSSSGDSSSDSSSSDSSSSEESSSDESS

SEQ ID NO: 23202 - protein, 110 aa, Candida albicans
YWSRIERLLFFSNKKRNAIQNIYSKSFTINFFSNELFYSHYIVSFITIHLKQVLKFLLNKKCKETEVLARKLGMSDKKVSIYYFDCGFLQGVEIPLRVLIATKLLKISII

SEQ ID NO: 23203 - protein, 296 aa, Candida albicans
LAGNPRKLGISPPSPPKLNFTATNMSNSSSSLSSTTTATATATATATATATVPTPKNDVTLVDALTTEFDTNINIDKDYRMKQYLTDQNNKFDRLITKNLDIVLNGDITKDPNEKILQLIYENRLSIFNYVYKTGKNQLSTRLPYIPYFNPKSTSSTKNYHDNEEAFSDSDSSTTSTLLGSPFSEQVDDRNIDAIDLNEIEELISLLDNNEQKIDYFINSLNDNTKQLLKRRLEKDFHGKGEAIKNLIIISCRISFKIMKKIQDIFNHKNMDTLIEYVLKIMVYVDSKLDEENKKT

SEQ ID NO: 23204 - protein, 206 aa, Candida albicans
LGRLTVKQQPCANLWKVNKGGKTTFWVFFIAIVEEILPKYSPPNDKNFFNSIDEIYQDNFKLQNLLSSSSSLPNLSNHLNKFNIEIEILLMNWWLTLFIDLKFIELDTWFKIFDNLLITNVDDIGDEEDDIDDNSNNYHHRRRIILPAMTLAILKNLENYLINLNSRDLIYQFLNHGDDKFKIKFSDLMKHYNYFLKRKEVIDAFR

SEQ ID NO: 23205 - protein, 64 aa, Candida albicans
NLTRIRQPGGEDLLFHTSRQSAEKTNSLTRSREKSKIKNIIFRCSHSFLVVVGGCGCVVVALGA

SEQ ID NO: 23206 - protein, 85 aa, Candida albicans
  UNSURE (74): Identity of amino acid sequences at the above locations are unknown.
QKKIVCACELVKETKKKQFLHLLSSVLRHLITQFEISPKDIYLKQTVFLVFINLSKNLAFIYNQSNFLVFKKSXNLDPRAGRIRV

SEQ ID NO: 23207 - protein, 64 aa, Candida albicans
RFDYKNRKEEEEKEVIKDLEKKKIKKKEESKSNQKGNLREREKGKSRFHTIKIQIQITYNMKQN

SEQ ID NO: 23208 - protein, 441 aa, Candida albicans
RRLQSDYSTQWIESTRLMNNSYLEQAREEIKQVLETSMQSLHTNKAEKLFSKIRRAIAITIVRTSYEVGLSLLNNYVAVVDISTQPKTKEQLVSNSYVEYLFYQYVLHIFSLIWFPSYDNEFHRYNLSQRQFPGKYETKTNVTSNSFKTLDQIYSKALNYYQKNELLFGQYDNETRYFWAIKLFNLSLLFKQFKLCEFYDQFIGFFLIEKEPLNFLVDDLQMLLSNLLVIFGITTIFLKPFNELTLMKLDKDDALIDLFTDVPESLEFQLYNSVMIPLAKCQFKQVIVQLQNETFVAELAAQLEYNLPVAFRNASGTNSSSLINYMASIIDYKNFFVILTSSRQISRLQMLELMGHDTTDDRSATKLTNDLIGVIVALDLQKYGIYYDANNQMFVNNETTKDSNADDVAKLQENIDDLKNELRAESLATKMTALLLDKYYR

SEQ ID NO: 23209 - protein, 175 aa, Candida albicans
ENNILKKVLKKNEKKKNKETKKKGRGTKDGKYLFMDKNIHGKKNGREIPPLQPLVSFDVIACCPYHENMSIEVISNSQNTEAPFSQEFIINFIKENVDVPSKQLITKIAECLKEKSSMHKFFVQSTSLQNKDDLNDLQIQSDFAALWDTKKDGCLSIQYGMNNEILIITIYWISI

SEQ ID NO: 23210 - protein, 259 aa, Candida albicans
NHFTTPKMTDDSATPASKKRKLTFDNEILNPLNFQPMINKQKISTAVIEKFWQPLDSVNSQSMDNIMNVALLKTLDELHSKVSRSITNVWFNSANPESFKSRLSQTKLPPPSSMYSSKLRIRANEVADVLSYDSLTRKRTVLDTYLLAELKQLQELENHYNQSLLAYKLDLEYLKKFKSTVKNNELKYNEELERKREELNLSVQNKNPDDIYLLSTDNDFDPETDDDTKFILETIQENLFQSKLKNLNDKLEVLCNVLD

SEQ ID NO: 23211 - protein, 194 aa, Candida albicans
RIFHSKITKTDEPLPSNSSVHSNDSSSARAKSKLDHPSSPGSLLSPSTPALQSIPADRVAQTTSPINASLPAVEESDIEHESESEIQGDETESLGLQVLPPIDDVVAASPSSLTHEPQEQVLDSVESCISLPPNRDQAFAGKDGEMCSLVDLKPAALKSATDLQLGADGMCNLGYKIKKHHHTEVSNVSNSSRR

SEQ ID NO: 23212 - protein, 63 aa, Candida albicans
  UNSURE (19): Identity of amino acid sequences at the above locations are unknown.
YLGQNCGENERGDPPGGRXWYHLSRDGQSVGGGEERDFGGEEGSWLINFEEWVGDYHWWLKRN

SEQ ID NO: 23213 - protein, 168 aa, Candida albicans
  UNSURE (126): Identity of amino acid sequences at the above locations are unknown.
MNKLIYLPIELLNLRHNYKYDIYLPELDISTQQQQQPFFPSSSYYFSSKTVIRIFRTRQITTIVSYYALVWIHNTYLVPPVNSALATNDNRPPTLQNLSTNSLPLPQSLFPRPPLHSGHPYLNDTXNGHLGGPLSHFPHNSAPNITENSTLLAPLEKKKSHWEPPCSP

SEQ ID NO: 23214 - protein, 62 aa, Candida albicans
TKWRQLFKCLGTPARCSPFLLGIYTFEPLLLVSPINSRTYINYTLSIVHIIIQLRLRQQMRQ

SEQ ID NO: 23215 - protein, 73 aa, Candida albicans
LIIKTMVADHTARKKSILSMRFPVIANTPQLGLAIHQRQKNKKRKISSFNEKPNMKTLDNTTVAVIDSKRTNL

SEQ ID NO: 23216 - protein, 251 aa, Candida albicans
KMMSFSLLSIVSIALAATVSATSDGTNAYTAYPSVAKTASINGFADKIYDQLPECAKECVKQSTSNTPCPYWDTGCLCVMPQFGGAIGDCVAKNCKGKEVDSVESLATSICSSAGVGEPYWMIPSSVSDALAKAANAASATTSAETATKSAAVELATTSDTTIVASTSHESKVAETSDAQQTASIEKSSAAETSRAKETLKAEESSKAEETSVAQSSSSANVASVSAETANAGNMPVIAIGGVIAAFAALI

SEQ ID NO: 23217 - protein, 76 aa, Candida albicans
LDYWNYDDWIIDDLVTYFLFIINTYFGFLFCFLYSDTYTLYTTVQTYSLKYMFIIVFIIHFTVLFFCNSIELILLG

SEQ ID NO: 23218 - protein, 72 aa, Candida albicans
ETLRHFLTGEKMAAEKEHEFSIAFNKNQSFLLFQMSNICLLEGMIESINREYIKKTYFFFHPQLNKCNRFHE

SEQ ID NO: 23219 - protein, 78 aa, Candida albicans
TLELFPIDYCCLEDKDNFRAWVFFIFCNPDHITYCISEHLQIDRQLFLSSKVFELLYYYNSIIKANIFLIIYSYNNSF

SEQ ID NO: 23220 - protein, 62 aa, Candida albicans
YVVFTTGLEDQRASQTHREGEGASGRHSRGATRHLQRYGARAAASRHSARPAPITQQVSADA

SEQ ID NO: 23221 - protein, 64 aa, Candida albicans
RPISVLCITCLCKLLVSTVSGSIIPIFPIPAEDKYSKAGEPNPPAPTTNTLEFFNLIWDSKEPN

SEQ ID NO: 23222 - protein, 65 aa, Candida albicans
LIDQLSKYIKTKTIYPKKIINKFHPVSFFNPFFLKIIYLFIYLFKETNNINYIIKKKKCHPNNNT

SEQ ID NO: 23223 - protein, 109 aa, Candida albicans
YYEIQRKELFFIRDVLKISPRRGRKSGRNVVGGQRKDRKEGCCVVAAKWDDDDDDDEEHEGQQKKEKKYANGIVGIVLIAVFVERVVSRVFVDFPQIPTNVYSLKVLNI

SEQ ID NO: 23224 - protein, 66 aa, Candida albicans
KKGQKRTMNLVMSDKNLNNNNKNLIKPYDLVLVLILILILILIYCFFVGLNRVIAIVFKVEYRYRL

SEQ ID NO: 23225 - protein, 300 aa, Candida albicans
FSKAPFNWKILNFQVIMELSNYTHWEIVSYVQVFLFAILLVAFLVITSIKKKERKGLRQILPFFIFFTIFLVLKIVGGILGLVFIHQKTFNVSLFIPTFIFDSIGLGFIARSITSLVTHNFKYQDDLPEFFRSKHQKAKNNNSSNAYKKSDNDSDNYNDDNDEINYWPFRVLTIILIAAIVVNIVGTNISVNNQGSSMGTSLIKVGSILFLIEILLMILFLVTIGLSGSQLNTVVYLLIVGLVVLIVRCVFSILSGFHWSTWENPSPYIIYFGKYQYYTFLALLPEVITAIIILVAFMFW

SEQ ID NO: 23226 - protein, 82 aa, Candida albicans
IEFFYWTLMILKLELKKSLFSLTTIIYIINFRRSLFDSSWAYITFSINCLFNHTGVVCIDLMCKEGINCSLYVQSGVDSNFT

SEQ ID NO: 23227 - protein, 66 aa, Candida albicans
YFLIFIRIMSHDSSIACFQFFMNFSFNLFSKNCFFVVAKKNAEQLNLLIRTQLTKTLTDHVDEDHQ

SEQ ID NO: 23228 - protein, 296 aa, Candida albicans
LSIEILFTKPQTHLSVMSLTSIHTIESILSQINKDVQELDIPSIYQLSTTTTTANTIPKTSPYITRFKLLQIKNSLTNLNDQFHANFTSSNNKHYHNVKQTLDKLYINEIDEKLYIVDKLITQYDDANSPTTLNGDDQQQQNQQGEQNLQRGNSGVITNDEELSSLRQRLLSSSKLHQINQDNTSESDSTKLNEYHESIQDDIVNELSELTSTLKSKAIEFSNKLLNQDSDILQQTHDNLSINRTMFDTLNKNLNDYLLNKTGWSISIWTLLKFAVALIVIFVVMLLFIIIVPRIR

SEQ ID NO: 23229 - protein, 61 aa, Candida albicans
CRLAKIWKKISEGVMGNGGQRSKLMQQQMTEVGSMMYLRQELPKSSKATVQPTSYYLRTRR

SEQ ID NO: 23230 - protein, 61 aa, Candida albicans
KYSVKPGKINHLTFLFPYGRPITLNELTDELKTQSLSSSPGEDGFNYIFLKVIWRRRKSEQ

SEQ ID NO: 23231 - protein, 74 aa, Candida albicans
IHFITLRKNMLILINYSHNTKPITIIPFRILTKNSGKYIFLKNETTTEKKNKKTSLTNPNPYWCTHDHTNQALI

SEQ ID NO: 23232 - protein, 86 aa, Candida albicans
IINQLIQITTTTITITTNTITKMRFFTAATTALLFSAQALAGITQYTLSIEADDERVNGKGITFKHEGAGINYAFVSDSSAKFNYD

SEQ ID NO: 23233 - protein, 77 aa, Candida albicans
  UNSURE (48): Identity of amino acid sequences at the above locations are unknown.
YENRERRKKSTLLMKTKQTKFQMNQKHFGFVLFSAQDTVYIFLHKSSXLSSSYSTAEAISRIRRDATTTTSTHYITQ

SEQ ID NO: 23234 - protein, 199 aa, Candida albicans
CTTMGITITIFRIVNLLFLGNGFIQSISTKLPPHLIKSGQFQFLTNCSLLTCLVYIISTFFILTGQVQWFYNLVSNLEFNVLFSYWTMALCFPSMVAEDDVDRNLLLDLQVHFFPYIYLIIDSQPSLGLKESWGWTIGYIFIYWVYIEWECGKHVHDGVSGYPYPFLKGRGVLGRFGCMSVFAAIACCNYFVLKLRNGA

SEQ ID NO: 23235 - protein, 222 aa, Candida albicans
FFSSLPIFVSFIPSLVLLSLLQRRRIAMTRQGLISLVSLAICCSGLYDCFQLELPPGLVKGGHFQFLTNVSLILTIIYILQTIVTPTSYNLRLQYNVVSNLEFTVTVSYWVMHLILPHWLNTNSFERDYWLDFKIHIWPYVYLIFDNQEQIKPKKLWTLTAIIIVVYWCYIERVVSVNDDGITRFPYPFLNNKTLVERFFRVTAMWLLSCLNYFVLGFRNSL

SEQ ID NO: 23236 - protein, 383 aa, Candida albicans
SNMSINQDPREYFQPPPMPAMPAIPAIPVILPVQFQQPLNQQPLPQQFQPPPQQFQQPVPPQQFQQPVPPQQFQQPVPPQQFQPPPVQFQQPVPQPLQFQQPVPQQQLPQQQLPQEQLPQQQLPQPAPSPAPSPVPSPPPAPRLLPLPTPPFPLQPEADQIQEDDYETRLERAEQALNSRDLTSIYEASFQYKVDNWDLSVRLGPDLTRRLIPEGERLLSPYLEHELSNWIIDSFQSGYPRSMSNIREYAELFLSLSQAQVPAQAQGQAQVQGQEQAQAQGRSTNSVDFQWVVSFLNRKSDLIPSINRNNNNALQRNFGPTFTLIDNFVQYFNDKSKQYQIKPSRVFQYDETIYITGSSIANMSIFGYKNKANIPNCQGINIL

SEQ ID NO: 23237 - protein, 67 aa, Candida albicans
QLIAATLIALIIMYYLVFFFSSEVLVSAEIVSFSTPNTSFFVIARMWKTFRIQINATYNRKVAMGGV

SEQ ID NO: 23238 - protein, 61 aa, Candida albicans
LKKIYQIRIKILFLHISVSRAKEATILACFSFSFSLVTISIKDDKNLIYTREMNVNFIIMV

SEQ ID NO: 23239 - protein, 64 aa, Candida albicans
MKEIAEATKGKELRLKKQSGRKNEHSINAIEAFDCFYIYIYMYAHPPILSFWFPLSLKVVIYLL

SEQ ID NO: 23240 - protein, 66 aa, Candida albicans
LVAKIDNSLEMTVKLSIKPGFLVNTMQQWRDYNLEIEALQNLNYIVQQTMLIRCLSVCLSSYLLLS

SEQ ID NO: 23241 - protein, 66 aa, Candida albicans
  UNSURE (38),(51),(55): Identity of amino acid sequences at the above locations are unknown.
KDLDFIFFLTLINCIGLYLTYVKRARERGMRGGGGLFXEIHQNWADKLSGXRLRXWSTNPTNPTRN

SEQ ID NO: 23242 - protein, 297 aa, Candida albicans
DMKLLTILTIVELILVGGVHDTPDAPHQPGLKIDESNRKKLDELVHQLEILNAQNSKLENDFTEDYNLILRDLDYEDLSARSDLPILDTVFRLVNSSGVAILATDFLLTREPLLDTAIDTLIRAIDEQWVNITTIFIALDQSGLLLDTLMHSIKDPDVLPGLLRITKEVINQSGFRIFNVRETKDLADQSPEDSTSIDVFKRENSLLVLLFTSLKDSGLVVSLTNHILTTPELAPGAAHFVWRTLKLRPLTLYKIFDALKRSNLIWNLLREIINVPAILSNFSTIITQTISLKLNLQ

SEQ ID NO: 23243 - protein, 70 aa, Candida albicans
LLFFEPNAFYTQGQTKKITLLLYNNFLLLKNSPSRMIKTQQRYKGCMVTITTNILHIVVNANGNLCKIYT

SEQ ID NO: 23244 - protein, 79 aa, Candida albicans
LIDRLTKNVKMKTITCFLHKYIYPLIVPVVAVVAVVVILPLTSCEIHQLLKGSSFVFFLYFNFNQPASACFVSSRHFSP

SEQ ID NO: 23245 - protein, 60 aa, Candida albicans
LNSIFLPLQHLIKSVDDFKNLFSLHTSSSHTIEKIIAHLHRLAINALSHPPLAHYFKIWR

SEQ ID NO: 23246 - protein, 73 aa, Candida albicans
IEFLSSKRPRTVNIFVLLVIVELIEISIQLLVSTFFFFFFKFSLSFFILRSNYFHCELIGCEYMQDILELTAK

SEQ ID NO: 23247 - protein, 76 aa, Candida albicans
FIPKCHSENREKVEYHPAFSGSICRVKDDTHGVMFNKYATPWLPEIDIRKLMKEFLFGINGIFPSFPRGILEQATF

SEQ ID NO: 23248 - protein, 102 aa, Candida albicans
QDHFLDNNNNNSKRYIIHQLPHLELTQLLIPLQNTQPLNRHTLCNVIHSITVYEHPKLLRGTSPRRIRYATPPRSIPEQPISSTAPTTMINFHIPNPPSNFW

SEQ ID NO: 23249 - protein, 78 aa, Candida albicans
IHFPLVKGSIDVTLALNGEFLIGVEADMKRLIKVVVVVVVVVGLNNCLNIYWENKQNSCSKLRGGSKQQERNQQKNCC

SEQ ID NO: 23250 - protein, 131 aa, Candida albicans
QLPKTIQYGTPIMSTNNSTQQPDELDLIKSKIQDNLISSGNYDIINKQLKLQLYESGWYDKVSPIASRELMDHQQKINSSNSNSSNSYKKNELTFDQLFAFVKPKAEELVPNEVKQDILNRITKYLDDIIQ

SEQ ID NO: 23251 - protein, 69 aa, Candida albicans
VLQFFFFQLNTRKKPMKEIGKQKIFYWINLREKEKGGRQEVFFFEGGVYSVFCLLSKQKNNEIDWLSPN

SEQ ID NO: 23252 - protein, 95 aa, Candida albicans
KDFVNIIEAQSSFLDLSWTISNMLVCSSKFQGKLAISIYLVLALKRAKEFEKETNSCVHQTKERLTIVLTRNCNNWNTVSACAKFGKRKRVYKSF

SEQ ID NO: 23253 - protein, 68 aa, Candida albicans
IIQTLEFSVSNLISPMNPDLLKVFLIEVPKNLGFDDFKGLQHYITKVLFYSATDEGKYLKTLFSIISP

SEQ ID NO: 23254 - protein, 70 aa, Candida albicans
MNLNVPKTDSNGQDKFHQKCESMPKPTAVTAASSNSDQNTTLQHPKDKPLEHLVEQLLHSNEEPNFIHRT

SEQ ID NO: 23255 - protein, 388 aa, Candida albicans
LKDCNWEESPIIVHNPDFTTTVNPLNCQYIKDSWKYIYSILKNKRFYAEYCDYKIDEPSNYVFNHYVEINRTYLLSYNKVCWLAPGDYNLNIALAVKNGQGLGTTKFEVRYQELNELGETLIKLQTFYPPSNINEILPKNQFVCLNVGHFVIPPPSETESRFYFKQFQSNSDHNKLRRIEIVMEEIGLYLKSGFRVYFIDISQPSMLFNEYDLLYYSINETDYRYFINILLKNLYKALNYVQNAGCSDDLSYQYNRDVYGDGDPFSIINKYDKQFLLEYEKTNGFLSSSSSSSSLALNSLQDYVLYDNKKLLNYGRFFYLNKFTIRNFKFTTIYQQRQFINRFGDYLVDCKEQDSKKNVVDGDEIPIERNCSYDHYGLKWKLPILGQL

SEQ ID NO: 23256 - protein, 88 aa, Candida albicans
WNNCCIVMKNPILSTEHDKNPPPRSPAKWTTILIPSTSNSTKTSGSEPRTGVMRMNNPPTIMGDAPEIYKRFLLAKVPQFNMAPTYNV

SEQ ID NO: 23257 - protein, 219 aa, Candida albicans
LYSTSSYTKKHTMDDTLANIDLTVLRLTLDEALKIEELSVEDAMNSMIPDQTPEMNQLIEEEVPILIELAKENANFEFPVNERLNCLIQDFLKQPSIKKELINAHPHFIALLKHPHMDPNFCSRIFDEGYLNKHFDRKEFENNKDLLALNPGPTEPKPKNKKYSLETIEFVSYTETKKSTKDIVDQYDTAPLSIQLMTEAIPANTRIMKFFSQIPYPII

SEQ ID NO: 23258 - protein, 80 aa, Candida albicans
SVWIRAPNNNNGSGSGSGSGREQDNGIITSSIGQPGSSTSTQGPSSSNSATIPEQANSGNHIKFTLFNRLLIGLVSIVFM

SEQ ID NO: 23259 - protein, 61 aa, Candida albicans
SRRASGKKKVVEVVNARRELERGKEKEFFTIVHFFFQTLMTPSVNFYLLYVYKRSSIIFLY

SEQ ID NO: 23260 - protein, 65 aa, Candida albicans
SNAVSQCLKVIIQTIKLTANHAKHPTRKIHIDLLVPSSQNWKHRNPLYNKQMQRALERPICTATK

SEQ ID NO: 23261 - protein, 62 aa, Candida albicans
  UNSURE (15),(24): Identity of amino acid sequences at the above locations are unknown.
KKGKFPLTQKNNSSXSSLRVLGVXSFQTYKHTEIEVFSSWNNIVPQRGIFSLCIKKLDFSFK

SEQ ID NO: 23262 - protein, 76 aa, Candida albicans
  UNSURE (7),(27): Identity of amino acid sequences at the above locations are unknown.
FGHSFTXVKKKFYFSSSNITFLSSINXRSSPSPPRQLIIMIEFNQSLKKKKNSKHCYFKFTETYILTLSSKKYIHN

SEQ ID NO: 23263 - protein, 240 aa, Candida albicans
WIKVQDKVDLLKDVEKCGDLKQRTLELIPLDTKLNLIMNASNDVGMIEARITPLDFTLPNITPTVEQMDDKMQKLNLKDTHKPTNTLIPKEDKKASSFNSTNAIKQAITSNRYLENIFTGDNPALPINLNTIYFKWKVLKNNSKMKIKNFSEKNFIIDGDYIHLTPPDDLTMNMPPESSVININGHNHTHHHNYLNHQFNRAHNKTLTKTYSFHITQILKLKKYVTNPNYFSLTPTGLEG

SEQ ID NO: 23264 - protein, 72 aa, Candida albicans
ANGTKDQDQEIGTNDEEDNDEKFLITCNIYDLDLKSKMKYKHWLKVENDLQEIYNSSNPNWRYCIKYDQIHH

SEQ ID NO: 23265 - protein, 72 aa, Candida albicans
RKIFSQLLRDIHFNLRPILIGTSIGLGVSAPTKALYILIASRVVHISVVFQTSVFGSHRLRRKSLAKSCWFL

SEQ ID NO: 23266 - protein, 87 aa, Candida albicans
NKGESIIRKSKQRSVCCFGCGLKRVFEPVELLSILFNKDKVQVKKKKSSTIDRKYGTKHKLIESAVATDDIILLRLVVAAFLKKLKI

SEQ ID NO: 23267 - protein, 63 aa, Candida albicans
SGLIVASTFLFSLYGHDIIQKWSDKLSLWIIIGVPSLPRFRHCRNNKQKWWSLSSLNRFCRGI

SEQ ID NO: 23268 - protein, 71 aa, Candida albicans
YYFFLTTNHPTSLVLFVSAFFLENNTRPALIQNNKKRNFYSQLGKKLLWLAYDLIGILNFHVTRVVNMDNL

SEQ ID NO: 23269 - protein, 88 aa, Candida albicans
TNKDKAPNLYKGCTALENYMVLELRLVQEKSLEKLSFLEIEIENLIKSRPLLYPYQEVKRYIRHNTQYLLSLIMIRLHSYGKIIIICI

SEQ ID NO: 23270 - protein, 177 aa, Candida albicans
DTYAWIRRVPEVKISMKLSHQALVELFRKNFQEEIVALRLGEEATITAPSSSRVSIFHNKRANGLMTERANSISNMSGAGSTYSGSRLARSPTNASSVSSNNSSITRSGRASNTSGYPASVIQPGYTGLKGSSLKNGNGSVTSKSINGSGKTNAINTKWYRRCFVVRDHLICMNGFL

SEQ ID NO: 23271 - protein, 120 aa, Candida albicans
EYTCLFLFFIGTQTTVTMTWTPTSCFLKGVVIKPFKPKNKRLSLPESENLPLKNLYPGDQVYVFETNNLKWGRGYVIHPSIGNDLKVISIRLNEVDQSSVVFPMNRIKIIDNIDFWQNYQ

SEQ ID NO: 23272 - protein, 101 aa, Candida albicans
ITLAGYPEVFDALPDLVIDELFEDTDEALVGDLASLEPEYVEPAPDMFEMELARSVIKPLARLLWKMETRLEDGAVIVASSPKRKATISSWKFFLNNSTNA

SEQ ID NO: 23273 - protein, 84 aa, Candida albicans
SPGYRFFKGKFSDSGRLNRLFFGLNGLMTTPFKKQEVGVQVIVTVVWVPIKNKNRQVYSQKKKEYSLKRLLLQLIFVRLCFGLF

SEQ ID NO: 23274 - protein, 78 aa, Candida albicans
YNFRFFCLCVLMPFLSYAVLILKGDKLLLFFLQQLYSASKLFKCYLIHSLRNTNFFYHNSHERNYNCSLLVFFFKGCR

SEQ ID NO: 23275 - protein, 80 aa, Candida albicans
LLLLLLLQLTLKRINKQGVRGKGRQEKRGRLNKKKIAAVILHDLRIKEKKIIKNTSNQTFYRVMSSSSKKGSRGEYQLIE

SEQ ID NO: 23276 - protein, 74 aa, Candida albicans
ILLHAEADKNKHKEKNYVPTDERQKLRNSKYHQTNTILVKSESLKQGANVVIDGRYVWVNRIYSHQYYIYHFVY

SEQ ID NO: 23277 - protein, 455 aa, Candida albicans
NSTTKTSNALSRLFTRNKSSSNISVHPSSSDDDSSPKTLRESTSPSESSKSVSGNKLRIAKKLKFPKNQSSRKPDLFLDTSSTISEDSSSLRKIITGNLLNEMNKSRKSSMSSPMSTTFHSLFHRSHHSGSNLQQDNNLAATGTTPLSGKFDDFSKASKTTLCLSSNSSNSIISNPELAQIYNFANPNISIEDGETNMDHTNSSFLDIHKKMLVPADLFIQNKLNKYHQTEVGLGIYESELDHDKDNKIYSNLYHYLKPLFTPSFSISDSGQKGKRRPILSTSVEEIANFVKENFCLHQPDHDKSFRLKTRSSVSSLGHEKVEDFDYRQLSNLFEKLMALLSHNLQTAEPSEISLQALILNAWKYYNAYVRFYLLSIFQPLQLHLNGLSMISHNGSKITRIDDLLLASFRKVFITEQGIGSGDRETSKFLGNAESEDLTGNGLLTSTLAVLSSIS

SEQ ID NO: 23278 - protein, 87 aa, Candida albicans
LVIIPNKRQRQLHHQISTSEKDSTLSQTSYDEEDDNSLKTTDTHYGGGGGGNFKYKFPGAGKIEFGGGAGFDYKHGKKEDSDDDEEE

SEQ ID NO: 23279 - protein, 67 aa, Candida albicans
LHSKLFQLLHIINIFSINQLLEKNRTKKKKTIGSLNLLTIPIINCYVLGILDPSLHGDKSIYKIDNI

SEQ ID NO: 23280 - protein, 64 aa, Candida albicans
FFFSSGEKHPFSNCRVRLPDKLNFPPGPFWGQNPKFVGEQKSKFTRLRDPFHFIFNQCFESLTI

SEQ ID NO: 23281 - protein, 65 aa, Candida albicans
YLSLLILNFGIFLFYKVTGQSPPCLISYHTIPFNLKEKDNDRRGKETSTSIGKRCRNCLSIFSIR

SEQ ID NO: 23282 - protein, 81 aa, Candida albicans
FVLKPRFNFLRLRYHATETQLKNFPIKSVLVIPCNTSQVYTHDTFSILINTIYKKHTLTPFRDTLFKCFNKIIKIILFFIL

SEQ ID NO: 23283 - protein, 77 aa, Candida albicans
LFLQVPTRPSSSFSSSSSHFSVFNIIKVVYQLVIPSIIRPSSILEYKTITKITVTKQYILTDNYLNSNSVRYYYYYY

SEQ ID NO: 23284 - protein, 78 aa, Candida albicans
AIADRHSVVKTLENDPFVDQTANSNQNNNYGFQQIPTGNNFYKVGNNGNIGSANKNNSSNVSNNSGDYKDLDWLKFDI

SEQ ID NO: 23285 - protein, 84 aa, Candida albicans
PPQGAINIPKLNNKFMGFGGNKVVVAGINKEPGDVSTRNPHINTESIIPTVEIIPNRLKIDNILNGNKDNTNTTATIIALRAGT

SEQ ID NO: 23286 - protein, 119 aa, Candida albicans
CRYNIFPRYLAVVFVKNADTTSNNEPNNQPDILNPSGKDNIPIPINVFIELNIVCAAVEFPVIRLNECLLVDTRDKVGNNSLVSSNTELFDQSIGGGNGKSMCSVWLLLLFSEGMELSS

SEQ ID NO: 23287 - protein, 72 aa, Candida albicans
NYWTRMPLPDLTDPPSAPKQRRRSFMDYGGPNSINNFASSYSRAQQYIGTSFMEQRSEYMESPLQIPSRPFT

SEQ ID NO: 23288 - protein, 65 aa, Candida albicans
  UNSURE (26): Identity of amino acid sequences at the above locations are unknown.
GYQYCKLLYPRKVNPLFFEKITEGGXPQHHFKVSTGNNGLTKYGLFQVGLEFVLCKWTLDFIKSI

SEQ ID NO: 23289 - protein, 419 aa, Candida albicans
VASSESFIIDYLNNFYYRMCDNLVNTEPTNCDNDDRIIIDNYNNLMIDWVNALFDDRNEGLSDELIKSLNIKQIYKIIPIIYRQGIIDTNNKKINWEILNNGLEYLSQPFLTPIIPIIIKSLLRDFTIDNDLKFKIIRELIKDNNNNSNNIIIKMVINICGNEILTFNPPADIRESIIKTMVYLDKSDPIARDINFKEFIKHQLLGDIHIQIEENFLNKYISNNRLNFISNLIEEIYNFQKFNHEDSKIYINLMIFIMLLDSIETKSDKDYWKKNFNLPYPMNLETNDLVVVVAVDSRFELSMDNHYSSIFNDDSRSSSSSSSSSSNSKDVDNFLTNGDEDEDEFMKDDNNTNNNNNNNDERITTSQQLEKLNEKIHRHECLLNEFRKIRTNTTETNLFAKSIRLLNDKLIEKITNWTI

SEQ ID NO: 23290 - protein, 80 aa, Candida albicans
KKIWKKKKKNFDDVGWMSFALSFSQSKGEKKNFSLKGKERKEYSNKKKKNYLHTLNTSTLSGHSSTHSLPFLYTLYIQAQ

SEQ ID NO: 23291 - protein, 87 aa, Candida albicans
RHPYGNGNFQNEMRSKLIIQNTKKNKTYPSMYDLSAKNSFNDLIDSTLEKSENDIMYWFVMCWCSKMILQRKERKLKKNLEKKEEKF

SEQ ID NO: 23292 - protein, 72 aa, Candida albicans
NSSHLNPQNIKIVATNGLGVSQISIKAALQKKSDFISRSYQVYGYYALLNIENKQNTVEKDYCIYIKSKLLL

SEQ ID NO: 23293 - protein, 65 aa, Candida albicans
EINNKEYKNHSYSKYQWYKLFIIISYFICLHLFSQKRKAKMKEICFHSDSVLLLLSSKWFTFKVF

SEQ ID NO: 23294 - protein, 123 aa, Candida albicans
FPNDIDQDFFYITCNPKQRNFQSSLPYLPHLSNMNSDTLTKYQLTALYYLHDQLSNIFQPIFFENQLHEFFHKFTSNKLNDWMFYYIKYQDKYIIIMKNKSKNTTSTLTNIFTTRCKDRAWLR

SEQ ID NO: 23295 - protein, 457 aa, Candida albicans
KNPPKRSHINFSIGFISEVFPKSNHDIKMPPHGLLENRSEYSKSFNVLDYTQIVDNNQRLFLNNTILSKLLSNIVHPLVFNGLLSLTCCYFESNAYKSFSFVHNYQIRLIFHELYLRYHLISIRSLTDIIDKIDRRDKQNSKDTDDLYIGLLGSILLNYISLYDDNQTSFAFSNGIIQLSIQVIELAHKQSQDNFKGGYIEHLILASKSSFFPSYPSLPCLVEFKEMLEKFRRYLVMKKVLNNGILSNIHALNQFVNKLLGICNTNDSINDNPKLLKQLLREWLLIIPTNLYLFNTNPSDSHCIPNTTPTTDTLAAFAINNNDNNNIIQYKIIVMMYYETLSKVLDNFFPKTLFYNLYSFGSCFTRPIEFAKLDSQKIRLINLQIFSKYCLKVCKFFKIRFQLLNNLLTNNFEYLDQFVYSINELPIKKFNNHVLETNKIFGISQNQYSYLLKIYSI

SEQ ID NO: 23296 - protein, 209 aa, Candida albicans
NFWHFPKSVQLPIEDLQYINSFIQDTSNNDNNNFNQLLYSYNHQHLAHFSTSFYNDPQINFHGINMGYLDHDQYQYQNRQNNCFGFVNTLYKQYSQLINKHLQESYSNIFRGDKRQQLLLRLSVSLPLSLLLPLLLQHILQQQSVELLTDYEPVYARLIEENASIENNLDNDEKLAWIVNFEELRKQEMDITTAQDSSYQILPTNGNPV

SEQ ID NO: 23297 - protein, 459 aa, Candida albicans
LFLKMSHKALFKGRRFERDGTLSNSSSRAQSVSRTPLRSDDSDYESDTEEQDFIKIEELLKERLFGLQLQEIELAKEDRIGAGDRRQYQAANINKSRIQESSSINDIINSLEFSRNDVSLQSRELLLVQLYKLLVSRPLVVCNEENAGTPEFVDEDKVAKLINIFTSANYRSEDEFLYLFRSLIALICSDIEEFGSLVSTELLNHIQHVITEPSNSIVTNSIKANVITGYVVLTLILHNGASSFGIDERIAMLIELAEGYTASATTLKKEVEAGDREHSTFITDKNLDKKLVNEANAKVVAEASVAVAAIHGVGCLLTLIPHGSFLNEIMEDLMFKLVPLLDNDEDRDIAKAAGRVIGVIYEMYDYGQNADADNGGDFDNEYNENSPYYEQESLLAILTRLLNLSSKKVAKKDKKDISSVFRNISNTIKIYTDANSREQVYKRTQEGLELLDCTSDLSL

SEQ ID NO: 23298 - protein, 130 aa, Candida albicans
VSFAYSQSDKHDLRRFSTNDVILENDISDYDEDDDDDDDDSSDEGFNGNGHIIHNRTPISERTARVSSSSYYSDIEEDAVNEEEYKIKANLLKMLKGFQSFDSICTELNKSRTEVEQLIESFGAVNIVNS

SEQ ID NO: 23299 - protein, 60 aa, Candida albicans
IAAPFQIEQSTNNQDNKGKKKNLYSNPISVWNQPKHTTTHLTVDNIYSTKTFNQLFNFSS

SEQ ID NO: 23300 - protein, 65 aa, Candida albicans
DLIVVVLLDETKLHQIGERGRRIYPLTTYIKNQLGIKRKYHKKSIFHPLYHINPITPCQLIIRHF

SEQ ID NO: 23301 - protein, 72 aa, Candida albicans
KSYSTNSGVLVMPVARFFFTPEFKKKNRNQQADRQTDRYKSKGIMNNSSRAFASCTVSAYSKNNYIIANLTL

SEQ ID NO: 23302 - protein, 60 aa, Candida albicans
TLLSYRCCCYSWSTCSNHFCDKICTRIDLKDSTNFQYLNDTIYQTSSIKPRNQSQKNYIS

SEQ ID NO: 23303 - protein, 63 aa, Candida albicans
TLENISVFKLHFEQFGNDNLGYAYNVVDNDVRIPDTTFELLTQTHVLEFKSSIVTAFQYQGER

SEQ ID NO: 23304 - protein, 69 aa, Candida albicans
GGHGLSTPGQDTGGRKLLLLTWEAASKNGDAGCDELSEYNEWDEYCDGERGFNKLLLLLLLLLLPLPLV

SEQ ID NO: 23305 - protein, 102 aa, Candida albicans
GFLAITMRKVSRQNTFFSDVRAKEQLTSSGQNKKLKKTLRDINTEIEIINHRISNQFRFKWVQGSHEAYHVCKTTQISSIESKCFEHDLVHRKCEDHSRNYM

SEQ ID NO: 23306 - protein, 63 aa, Candida albicans
CPLVFLCFSILALNFSPSTDIENTIECKLLPDVGISFASITSENGSIDSEDTSSLDVVNSFTS

SEQ ID NO: 23307 - protein, 64 aa, Candida albicans
CLHPRVLIYSVLFSLVEGKKFASSRKGRARGIVDRQRLLMNHMCYKDQTRAVLKLQSCRVLGVN

SEQ ID NO: 23308 - protein, 66 aa, Candida albicans
KVLKEMKCQRVKILLVTRSCEFGINLGADTARKSQNTVVRVTCTQFNIGDQYYRQLCKSPAQLTPK

SEQ ID NO: 23309 - protein, 123 aa, Candida albicans
  UNSURE (43): Identity of amino acid sequences at the above locations are unknown.
NLIKSQFNFLSIVITPHTYFQDYYNNNLPVSSTEDKKQQLSEXYFKVKMYRRGGVPSFCGISHFKLISEKELPVFIRSTSLLASIFANVWHGSKNVWSQRVKQLKLISSYTLPQLNSTTAGAV

SEQ ID NO: 23310 - protein, 65 aa, Candida albicans
NLIIKGQIRMNLQNQSLLLQMIINGMNILQNKRILLCVNGTNVFKVIKVENNVWYTIHTKGCICH

SEQ ID NO: 23311 - protein, 235 aa, Candida albicans
LMQRSISKEISKEFTTTNKYGKDLFQAIVQTYGEMEVRDKVAYIGSLQDKLFNGAIKESERFTVHDELFDFLEGHSEGEKRALSNFLWLYYTLSSFADKYLDNPLLAKLDVPTMKAYLKYQDSLYPKTITAFTVDKDQRQEADDKDQREEADGSDPIFRVQCLNCFGLGHNSSDCPSPERDGMIPQLETRLNGFKTRRKAFQRVKFNYQRANQNESSESKFVTSNDNQWNEYTTK

SEQ ID NO: 23312 - protein, 77 aa, Candida albicans
RSHLLTVIHILCISALPLYSSRSFWQLPFVVFLRTEHYHINTLCQTIVLLFACLLWIVKLFIVTCRHDIRHDTTQQQ

SEQ ID NO: 23313 - protein, 204 aa, Candida albicans
SNIHIFSLLQCFFFFQSTMDDNNLYDISLTSTTKRSVCQSPLPPPTSQVPLLPPPLSRNSSNNFSTTSLSLASPSSSIPKRVPSLPTLNETTNSSTLIKRPGDYYIQKINSSKSSLNFSPQQQQHHHHHQHQQLMMKQRMSTDSLTSAQSSISDDHSIISSQFDGVASTSSTAASTNTPDSRLNSMTSDSFKESSPRRSKTITR

SEQ ID NO: 23314 - protein, 64 aa, Candida albicans
SPGRLIRVEELVVSFNVGNDGTLFGIEDEGDANDKEVVLKLFDELRDNGGGRRGTCDVGGGNGD

SEQ ID NO: 23315 - protein, 96 aa, Candida albicans
  UNSURE (95): Identity of amino acid sequences at the above locations are unknown.
VWKKGWKKERTEKKCVKEKSTPRNCEKFGSTDKIKNHYHPCNDKNKTTRDEKPMNVTQQCNKKKKLVVIKKERQEAKKNSTLDRWGVGASQICSXI

SEQ ID NO: 23316 - protein, 65 aa, Candida albicans
VVTTIYFSFLPSELHTTNLLNIGKTIHLIFLSRNYYNLHSSFPSSKKKKEKNYDLHSNLLSFTRL

SEQ ID NO: 23317 - protein, 77 aa, Candida albicans
PEEDNGIGPPDYECGVSLKERKLSDDKISDEEEEEEETGESEPDFPRRRISRRKNPEKKLKIPTKLRTTWELICSQK

SEQ ID NO: 23318 - protein, 64 aa, Candida albicans
MSDLKKTDSANVSIKSTTSTLASIKSKATSLGQKLKKKPSSKGHSPSKKTTQVEAMAHYLAMKS

SEQ ID NO: 23319 - protein, 70 aa, Candida albicans
LLQENIQLEIIYLLVKKWIHHDHIHFLLKTYWSNLRMQLEIERLLVSRQLSCLRDLIFFSTVVYCWWQQK

SEQ ID NO: 23320 - protein, 78 aa, Candida albicans
YCNELPELVPIPPLAVAEEALVELEADVLLLLLVAVVLTDPEVEVEAVAVEVVPVVAVVLIPATIGKLDMVDNICNRQ

SEQ ID NO: 23321 - protein, 409 aa, Candida albicans
LFFKIVILFYCLLQMLSTMSNLPIVAGISTTATTGTTSTATASTSTSGSVNTTATNNNNNTSASNSTSASSATANGGIGTNSGNSLQYYYTGNNTSNSVDGNKYSLPSIYFTPQDSINNTSHTYNPYTTVSGAVTPQNYQLDYSQSSTVNNNYQFTLPNQQLSSPQQQQQQQYNRSYSNSLMPNYHYNNTTTNINANVGSNTSPQLSNSNTPNPISPVLIPDKDNTYNNTNNVLVSSYPSMTMNQIQQQQQQYLQPSQQYQYLYNQYYMQPYYHNPQQLAPQQVQKPAQTEKLPHLSVTNIDYSSLVSYTVSPSLKRKRRTAKKSLSPSSTLSLSMMINHDSTNNGTTSTSTTTRSSSTSSATSSPMGVAAAESFPCSQCNKFSKKPFNLKSHMKNPSNEKTISLLNMF

SEQ ID NO: 23322 - protein, 62 aa, Candida albicans
SSVTGSINKKVIVKQQWKMGLLNLVVDASLFILLSNIRQSCYLGYFAKKFAPIEMFFLFVVG

SEQ ID NO: 23323 - protein, 74 aa, Candida albicans
IWWLMLPCLFCSPIFDSLVIWDILQRSLLLLKCSFYLSLDNERIIEEKKNNNNRLRRKKMGNNINIFNTGSNFN

SEQ ID NO: 23324 - protein, 81 aa, Candida albicans
LIGWVKNFFFHKENNESEKNLNPTLHTQHNTTHTHLTIIISWNIFYKQLRLFNENYFCYYYLTFFFSCWVDPFSINYLTTT

SEQ ID NO: 23325 - protein, 68 aa, Candida albicans
  UNSURE (26),(31),(48),(50): Identity of amino acid sequences at the above locations are unknown.
ERTILQSNIRSCILLPLYKTTARREXREKLXKEGTESHSSSPVVVEKXGXTQTTKHVRKQQRNRKKKK

SEQ ID NO: 23326 - protein, 241 aa, Candida albicans
PLFIHSTYCIMSSNRNQGIRLPPISFLSNQYLQNLQQHQQQQLPLQLLTSPQISTTKLTPASNIGIQMYLNNPSSQSPNIASLSPPQSNEDNVNKNLETLASPPQILSSVSQNRPPPSQQQSPVYSQFTLPHINQPQQQQQHSPPQQQQQAQSPPQQQSAPTPTASTFTHSIIQQQSYSPPQSNVENRLDQDSIKFKTIQQSEQQQQIVQQPQQAAYQETLGSRKIQNTSNNKQLIFIHTS

SEQ ID NO: 23327 - protein, 82 aa, Candida albicans
ENLTISKSLSSSVFENVSLVENMRKSWSKRRGDICMYTNQKPCFQTHRKIKKQCKDGNSRISINPRIQEKERQVEELEEVSS

SEQ ID NO: 23328 - protein, 62 aa, Candida albicans
RINFYLLSNFLTSKLDYYTIKPPKFSLFEIFLNRFFHSFIYFNQGNPPEKESSPRGWKDPRC

SEQ ID NO: 23329 - protein, 70 aa, Candida albicans
WLICSRLGSLLCIMGVGLELSGETQKSEKKKKKIKKLKIKKNLLENNVHRYTKFDLYLSELLLCRMNDGV

SEQ ID NO: 23330 - protein, 78 aa, Candida albicans
FFLINGFYSALDVFCLLSTNYRKLPYSFSIHVLIFWPYFQQHQSITDLHSLRISIEKVVEIKPKRVRKWIVFYEKCNY

SEQ ID NO: 23331 - protein, 337 aa, Candida albicans
RRNVPQLSLQRQKQEQSDITTVDDGHGRATFNLMDNDDNNSIHSGTTGGVTGGNGDYFTSSTSRRPILPRSNQSFLQDHMVAMSPPVHISRVNSDINLGNNNNNNNNAPSNLSPLELSQVPSYAEAMNSDPPTITNEELFSPAYEPPLPGSHINLQELNKNLTNLQQQNNNKIGRHNSFKNSNSFKLQRSSSTTSRNSSQNSSPMHSRTVSSNNLSSLSGHHTNNSHHHHQHHHSGATSPSSSMTNLQRLTPAHLARSSSTNQSLNIPTTTTSGGGDGGATFSLSSSPNSTTASTTHQSVGKLSNSAADRTNGGATPIRTSSSLSLHNLHFLSKKKK

SEQ ID NO: 23332 - protein, 68 aa, Candida albicans
LRCRVFSHLNHTCNYKASEKRRPLKNMRKVKANNCITKSPYYTSVYLYILLLSISFSYLKNVNYVNSN

SEQ ID NO: 23333 - protein, 67 aa, Candida albicans
LPVDYSTTLKLKQVLGYHASEIVPRLSHPGFHELNFMKFFHPGLSSFLCANNNQVKIGLCLVKAVSP

SEQ ID NO: 23334 - protein, 228 aa, Candida albicans
LMLSAAGGEDIRGKIEGIPSVNELYHTKNKIVPNGDNYNNRISVDLYPLDSFTPISTVVDSKYNFKFNNLEPGEYELLVNSYDFGFEQNRFKIIADEESIVAYEHGIGQETYNTTSLTNLNEKPLSIKYLATKEFYEYHGGSLSDLLMNSPFGFIFKNKYMTIVFTACLVIMAAPYILQVVSPEFAAELNQIQTQTAKERLGEKVIESPEPTIKSTGVNKSQGAKKRR

SEQ ID NO: 23335 - protein, 71 aa, Candida albicans
LKTPINGVMFSELPNPTHIANAKINWGTVSQLATAINPLDIITVPTTIGNIAPLTSNNGPTTIQLANEIAV

SEQ ID NO: 23336 - protein, 68 aa, Candida albicans
  UNSURE (31): Identity of amino acid sequences at the above locations are unknown.
LVLIEKFSNTSIQVIPLVTARTYPLQLTLPXKYEIFPHLMNGFPNYVTPPRIPIQKKTIPLPRPLFVF

SEQ ID NO: 23337 - protein, 85 aa, Candida albicans
YESRIIKELKSEPMNLILFIGNIIVLVLCTIDFLVCICTMGKKQIIISRVRFRLKKNKRKKKKEILLLLLSKAQLIHTTINTLFI

SEQ ID NO: 23338 - protein, 62 aa, Candida albicans
VRLNPRNRKQQQQPQQRVCILSRVPECIVQIYVVNHLVLIDKRSGLFTPKYKLSKYIHNLKV

SEQ ID NO: 23339 - protein, 93 aa, Candida albicans
LSTLRIMIINSSYEPMLQQPHNDNSSSSSPPPPAPPSYASHILNDIGSLAPIRYIGSLIEEANREGDSDGGDGNGNGNNNILDTIEQVEHFKY

SEQ ID NO: 23340 - protein, 74 aa, Candida albicans
NPTSSRDNSKMISDKLNITHNENPPTISHPYNIVTLAPSINEIHNVDDNPNGTPIKENPNPMTDVTVNLRSKSC

SEQ ID NO: 23341 - protein, 77 aa, Candida albicans
LVIQQEKYILYKRNEYTKLNGISSYCCFNSRIGIRRIAAKSRLGIKSRAVECAKNDLYLNKIPMALFPFLAFLFFPN

SEQ ID NO: 23342 - protein, 108 aa, Candida albicans
YSYSLNLVSLLTLESSTYTLHLIIEPTIQNTTLVYKFFLFMLSGQFRFSCLFVRACALPNSLTVLFFFLSLSFFCSIFFLSHESYFISLTNHIATIPTLTPPFTKHYS

SEQ ID NO: 23343 - protein, 62 aa, Candida albicans
MEKANNRREGEKGSKSNDIYKQILKKLEGRGGEKKVRMKQIHKYGRPVKSISHKIWIMNNAW

SEQ ID NO: 23344 - protein, 66 aa, Candida albicans
FVENLFFKVFKWEGFHREEIIETKVMLKLLFLEGFLKNEKKFLWEFMLHQTWVSVMEWQSLVMESD

SEQ ID NO: 23345 - protein, 97 aa, Candida albicans
LVRFFCSARFSFFFPFCLYISQNRLKKMILDLFRMFEFYNDVSEYYHIHSLCLLKVVVLDYNDIYSRHNLLKAIMLFSNTYIYSIFLVFKKVSQSLT

SEQ ID NO: 23346 - protein, 60 aa, Candida albicans
  UNSURE (36),(54): Identity of amino acid sequences at the above locations are unknown.
TVTFPKGLVLQSVGIVKNETLLAVSFVAGYDAVSSXTEYLHNGQVVCSLSHSHXQPLPNI

SEQ ID NO: 23347 - protein, 250 aa, Candida albicans
LQIVFNLLKSQLNPLLSFSPSHHIYYFKMPDDSGSSNGRNNSNDLLGGSEEGSNNRRTNEGNHNGHSNRNDRTSASQNSSSNRSNSNRLHRLDFGIFDRFMDTFLRGSRQRNHSTPGPSPVRNDISEQLTNENNARDQQHQHQHHGQAQQHQQGSEQSSQRVLSEPPSSNSSTNNRDEESDRAIIITVNYVFSDENRPAVPNRSGSLIMSLPNNASNREPSVIQEFIRLATQMAYSSIVTGLNRERGTTI

SEQ ID NO: 23348 - protein, 71 aa, Candida albicans
PATNDTANNVSFFTIPTDCNTNPLGNVTVQNNFTNAPSNDQPTPRVHYFGINPIPSPGSATPSLKPMSDAT

SEQ ID NO: 23349 - protein, 173 aa, Candida albicans
GSIYINPNEANVLLFFEHLQYFFFVITMTLNKYSQLEETKIIFNSLLSLLPEEFITENVSKIKFENDSNNLIVPCPLKQTETISALKGLEALVALKLTQERFGSNDGTCKIDLEHALLFLFSTYCSSVDGFFKTDKKEVLKYLKPTDLNQAQSDPYRRMSANLYRTKEKDRLY

SEQ ID NO: 23350 - protein, 155 aa, Candida albicans
SLSKIIRTTMTNYSPGIQNNEKLKEFIVKFYKASDKAPRSDEQHDPYLDFFTTNSPLVMGLKKVEGHQEIAQLRQGMWEKVTHRHHVVNNVAEINEKEILLNGYVEYTLINGKNVTTEWAGHMKLENSTGDENGYKMNYYQVYLDPSAAAKALSE

SEQ ID NO: 23351 - protein, 60 aa, Candida albicans
ISEKSQKKKKNYSNNNKRTKIKFEYPLIIRGLCVNFQTVPKKKGKTEKLIKNKSKGGRKV

SEQ ID NO: 23352 - protein, 72 aa, Candida albicans
SMWLIRKKKHTNLVGDPYCNSLSNMPWRRRRGGESGGLTNENEMNKKFFFKLLDMIMSALNRTLAFTVHNQQ

SEQ ID NO: 23353 - protein, 67 aa, Candida albicans
  UNSURE (56): Identity of amino acid sequences at the above locations are unknown.
QRTLLIDSCNFSLGQEYNQLVNLKVYSETTAFTRNYQCHNKILFFHYIIINIILIXKYELRKKLQIL

SEQ ID NO: 23354 - protein, 253 aa, Candida albicans
DANIPCGMNLSELLDYLEESIAFPKLIEPDDFQYNDEKCLIVFLVELYKIFEIEKSYNNVTVDNLLGFDQVITATVEIFKLKSKYESEALKLSNQLNTLINQLSLDISDLKNDFTMDILSCLKLLEDSILDSTKLTPFQNSFNHLNVKLTSLVNILQRFQNFRFEIKSELVYQSYPQIIQILGSIKSMLQSFGDIDYIPASKTLNIDPISTKLEQLITLDSLILAEISEVILNTNSEELFIQLSKVFNSRRGS

SEQ ID NO: 23355 - protein, 73 aa, Candida albicans
MIHFSMVWELIITLISIARMVPFKILYRVFRMTTLILHGALGDQSPIGNEPEADPISLLTTEESIYESMDKQQ

SEQ ID NO: 23356 - protein, 71 aa, Candida albicans
YLSFFMGIRIVENGCLILGVECIELIGFFVWEKKGGWRKEEGGGEFNYEVERVATKKKYNRESNTLEWKYE

SEQ ID NO: 23357 - protein, 64 aa, Candida albicans
CLVLEHKIIIQILTQKWLINAVKSKTFNMISGQTNLPKEVETLTTNTTKKKCMLSTAISKSKYW

SEQ ID NO: 23358 - protein, 86 aa, Candida albicans
PNPCIKSVVPPADTGVGVKIEVEDLVKLDVRDIVVVVVVVDDVVNGAGDGDGDGVIFLNDKDRIISFNLFFLICSLIILAVVSKLA

SEQ ID NO: 23359 - protein, 281 aa, Candida albicans
TDLPLLYLLFFFFGYKHIIMSPKYKNYSVINYLAFNYAGFACVAIIVFLSSTQPFFIKEIIGIDPTTATTSTTSTSKNSKDGKIGHIVGGLGFIDELTAMIVAPLLGALNDNLNSKQYNGSKLIQSFSFIIIAISLFGYAVWCKNLVPNMFIFRSIFAIGVTGCMSMVTVILNELTISDFEFWRSNNQVTSQYIPLNQEEEGDDGNDEQQQHTSPDTLKKNGKFAGLMGVCTGLGAIYSVSVFVTLPINLGMKNAYLVVRVLLYSPLQYNFPFLYNVQWQR

SEQ ID NO: 23360 - protein, 70 aa, Candida albicans
TIWCKSFVKTVKQFPLEYFMQLSLFFEFQGNMTPGFPTFITLNLFPNPGNWAARLTISVEIRYVNFFSFL

SEQ ID NO: 23361 - protein, 71 aa, Candida albicans
SIPIFEYVVPTIRYLLCSFTSSINVIVLVRSINGHVSCLGVISLSTTIQDLRFKKLLLLLIILLQSNPSKL

SEQ ID NO: 23362 - protein, 66 aa, Candida albicans
LGLFSLKLSLTLVSLIRGDEQVVWLVLKDFAIWMSCNYLSIIRIKVSLNEISIRFNSSTHVQVTQH

SEQ ID NO: 23363 - protein, 521 aa, Candida albicans
ENIDDKTRLRSNSVKSDNIKVGVRQRSSTTLSFWSVGTDNKSNNDKLRRGSTSGKEVSLPAWMFLRLLPFYTDDNVITNELQSVVKTSKEFATRRPILPICLKRYRFNSGAASGTRSQKRIIIPPFIDLPQFVADDIDDNSCSFRLILESAICHRGDKIELGHFIAVVRKHTNKINETEQEANNSTWYLYDDMKKNSRVVEKTFTEIFKDEWPYMLFYRLVSNHEVSGASSINSDNNTNNNNNNNNNNNIVVPPQGSKGNYWLSQEETSPQPLETNNNLSVKTPTKSIPILNVSPIDPKYIDIRNKYYWYFTDDDKNYFKEESIKLKDGNSSFTLSPQFRRNSQWSVNSNISFVQLDKDKDKEKEKEKKSSSNNNNNSSIHTITSKNSNFTKSKIEKPDIDDSITGATNTTTITKPSNLLNKENEIKSSPHSSIWKRAIKLTTSPSVKIDSTESVGELNKQISPINLDTSINDTTTTTTTSLPKTLRNLENNQKKHRHPFSHKKSKSKRQDDYKKEHCIMM

SEQ ID NO: 23364 - protein, 234 aa, Candida albicans
MPSLSEFTEAFLLFIGRVCSIGLGSQKKSLLYNNEMSNLNTLLIKIEDEPLIDIDKCKPLLIDSIDKFLQMIIQQEYVDDKLSWFAINLYLSKFIRLVIYPEIQMLWPILLRTTVFTHDFRVLHKVIECALCDNPVVSWISSKILLNIVQVDYMFSLVKESINTKENIRKFKNLLWRNSGITTLTNLISLFVNLQLEPEFIPNLVTPYIRYIHSVNPKFSDFIPCTVVLKKSNH

SEQ ID NO: 23365 - protein, 100 aa, Candida albicans
HSGWIRLELPARAELGLSKVQRFFFNWAIILFSYFIEYHLSTQALFIEHGMELKIKHSSNSFWDTNFYNWFMHATGQQTVSLNFPSEILVIPIETPLIEI

SEQ ID NO: 23366 - protein, 73 aa, Candida albicans
LRAHYIYFVKAGQRVEYFKRVCVLKKFCNTDRNENRQAKMNAEKTDRINLYNKPAKQQHLCNSRTGQIPFFHF

SEQ ID NO: 23367 - protein, 63 aa, Candida albicans
DDDDDARILVKIFTNIGNSIFVVSMIIAIILYSQSMLLINVSMILPAVQDLLDFMLFPHIPIV

SEQ ID NO: 23368 - protein, 64 aa, Candida albicans
DIDNLQHGGRNGQKSLDVAYVLGEGGGWSVKHQRTSFTKYACDFRLKFPQKNYHLSYAKGLHSL

SEQ ID NO: 23369 - protein, 67 aa, Candida albicans
IIYISKMPFKQNWKGERKKERSVYGIIMNFRNFREIINKKKKTQILLGQMQKIFFFLFLFGRGVMMD

SEQ ID NO: 23370 - protein, 85 aa, Candida albicans
WKKKLIEQIIIKLTSLKNRRDRSKALLVFKKLCQAYTSLRMSRIIPLRIYNNQVWGTVPIILLSFLNPILSRIVEHPNSVMFNIS

SEQ ID NO: 23371 - protein, 103 aa, Candida albicans
QSIVNNNAILNKNSKSITQNLNQIFRFNLLLTKDLTCHTCHTCINREFYNNTVNLIVMTDFNSHFYLSPVVVVVVVLLFFQSLILFFLFNLTRVVSIIIFFKM

SEQ ID NO: 23372 - protein, 65 aa, Candida albicans
SYYYACHTLKLVDLFSQHVQLMDSVHFMAYKLVITRNIPYLNNFGESNIITQKKLSANTLSQSKN

SEQ ID NO: 23373 - protein, 60 aa, Candida albicans
YFELNCLFCSKIGDIVWAGGVLLDAKKKEKKKTFSTAAAINSFQPTTDSDHIIMLVILLS

SEQ ID NO: 23374 - protein, 603 aa, Candida albicans
  UNSURE (184): Identity of amino acid sequences at the above locations are unknown.
VIGYFHDQAILNLKSVKRVFFRRFNMPVPTSTLIKTEEEERAIRLAEQQQVWERQRLEFEERRRRAESQRIGSPFKHPWWTAFTDAGPEPRCLDEWLTVEISNSIREKPDWKTKYKNEEIVTKWKREIKEQCPDKTKYLDQIIDYVFKELQWYEDVEKDLNTFQIGCDYRIAYSDGAVNETLKXSFSIGAQKLVESFGSDIDYHPGSHNQVIDLVHLSLYIVQYDKTSVLKNGQLEIVKYGEQIEHAKPGVDQYGVSKRFQWIPALMTKNSNGKFEFGSYINNLHPIKYKSLYDSISDIFNAAVPGLNCVLTRYASQEFVRIPVPRGSDAYTDEYHKEREELDAILDREAEETGNDYDWERMEEFEKDKLKYLCELIPEWEQAPVFDKPIDLSTFENLKVIVKLINIELTPEINPVYAGGSWHVEGGINEDIIATVLYYYDVENITESRLSFRIGFDDPNYEQGDDFYTETIFGIKDEKVMVREIGGIEAKEDRVVVFPNMFQHHVDPFELKDKTKPGHRKILCFFIVDPYNHNVISTDNVPPQQKEWWDDSSLDYLFPGNLKQQILDLKGDESSWPMTLEQAKEARVALMDERSAKGEGDEF

SEQ ID NO: 23375 - protein, 88 aa, Candida albicans
  UNSURE (61): Identity of amino acid sequences at the above locations are unknown.
CIGKTQPRRKKTKQIQTNNNINNRGKTQHHHHYTLVTMVKNTLYKKQKLSSRNRIINQEVXLFPPTKYEKSKATLKHFPSSIVNGVHC

SEQ ID NO: 23376 - protein, 73 aa, Candida albicans
  UNSURE (36),(66),(68): Identity of amino acid sequences at the above locations are unknown.
RRLYFITFKSINCASFVENNELMKTVFKVSKLELSXVTDNDDVDKLKNWKQTLENDINEIEKIRLXCXQHKYC

SEQ ID NO: 23377 - protein, 174 aa, Candida albicans
IWIKLRISFYQISLPLPLPIINMKFFTGATTALLLSAQALAELTSYKLYAKSENTEVDGKGVSILHEGAGIYFVFLGTESIDVTYDDVEKLLYVPVSSDIQFNFGTNADIVQFSVTPPVSVEIAEDGSVNFEGSDDLFAAQYINDPYNYSKDSYAVILRGKPHAIPIKLVAKKN

SEQ ID NO: 23378 - protein, 62 aa, Candida albicans
YNPPEVGMALPRNARLVPTQRIKMDARIQPQTKAAGPPSNPIDNTEDILGNKPMMEKAIPKT

SEQ ID NO: 23379 - protein, 72 aa, Candida albicans
GFILNFFLFLIGGWFMLFIVLDSIGNNNNNYNKNKDLTKKIVWECKLLQNGDKLTARLFIFVLFRFIQFWLF

SEQ ID NO: 23380 - protein, 66 aa, Candida albicans
IKADKSITFKAEDKREGSVEIDHGQEQVLVESKKAIDSNVEDSLKDIDKFLEEADDVDYGDISMDD

SEQ ID NO: 23381 - protein, 82 aa, Candida albicans
CVSILSVYFFFSSYRKWQLTELFPSISSHLVAINETILSRANMKKLKFKLKHNHHNSYLFYGFSSLFFFQVYHYVINSSKLI

SEQ ID NO: 23382 - protein, 62 aa, Candida albicans
FRLSCLQTNLTMHIDNKSNVAFSKAANKVNQIIYRNIFSIKHHCNFKLTTTCILRLCVNMIN

SEQ ID NO: 23383 - protein, 90 aa, Candida albicans
YERRKKKSKKEWMNDRKVNQYNQQEKKKERLANKVKKVKKEEKKNFVDYVEIHSLYFFLSFSLTLLLSHSRSLTHFPTLLVFFLLSPHTI

SEQ ID NO: 23384 - protein, 73 aa, Candida albicans
FFFCCLPTQFKINWRERGTKKKFRDLMESKEGKEKQFLRVKVAKKISIPSFVHSRLIHSFTYSHSLFLSFSPF

SEQ ID NO: 23385 - protein, 111 aa, Candida albicans
NTIIANNIILSAGHSRYFHQDKTLVPSIKHSVPTSHNFHLKYTQYSECFPLTYQLQHKITLLTIFISSNIITKNQTNCTISLHIQYNTSSEFVESKTSQRGFVEYLAFQVL

SEQ ID NO: 23386 - protein, 62 aa, Candida albicans
FVKKNEISMVLILIYNGASRNNRQVNIGSVLLYSLRLKLLYLLLSLDTKNMVINTCRYSILW

SEQ ID NO: 23387 - protein, 72 aa, Candida albicans
QECNLLNLFADILNESQYLGNWPITYILLINTSTLYFHIVRSILLGISLRQTELGDILGMKSSNQPMKLISI

SEQ ID NO: 23388 - protein, 86 aa, Candida albicans
YQSYHYLLGVYAKKSVYHGQLQKTIFLSFSFSFYLKDSFCFFSLLNLSTKVKNSFQPTHIIYRETLVSSTAFLYDIEHHKDKQQHN

SEQ ID NO: 23389 - protein, 91 aa, Candida albicans
AKKKNKRNLSNKKRKKKKGKWFFAIVHGTHFFLHIHQEDNDRIDTIYIYIMLCVLISFELRVLNDSRIIFWFHEFACYKIFEKELTIQVFS

SEQ ID NO: 23390 - protein, 94 aa, Candida albicans
LIIEKDGFEVFENDREILKKRNHYKQGWWKFRLIYILQSRFLFLLQRIKGSHTENVFMRALEIVVDDIQEGSLIWLNILMLLIVLTYLMYIKNF

SEQ ID NO: 23391 - protein, 93 aa, Candida albicans
GNIKKKKPLQARLVEISIDLYITVKISFLVTKNKRIAYRECIYACTRNSSRRYTRRIFNLVKHTDAVNRLNLLNVHQEFLVFSNFTSHLLLLL

SEQ ID NO: 23392 - protein, 81 aa, Candida albicans
RYCLFVWCITATHCWYITVVFGSDFVENDICDVRCCCFWYHKQKKTDNPRRKSEPRFLKERARKTRCVLYAMLHQKVVHAF

SEQ ID NO: 23393 - protein, 63 aa, Candida albicans
  UNSURE (49),(54): Identity of amino acid sequences at the above locations are unknown.
YMERRNKQISLSVCKRVCVQREKKRNNSINKQSFQNGIESPKISPPEPXRSFPXEPPFFYSTS

SEQ ID NO: 23394 - protein, 150 aa, Candida albicans
KSWFRFSSWVVCFFLFVIPKTTTTNITYIIFYKVTSKNHSYIPAMSSSNTPNKQAISSNERQSIIRTTLTPPSSTTSGNHPDPSLSSSSATQRKLSHLNSQMAQLNANLCDFNDLLVTTCSQYQSIEKLGKIHASIFMAGHTVFEDENFN

SEQ ID NO: 23395 - protein, 85 aa, Candida albicans
NVFLLDFAKASDWLMVQQCEKPTIACFAIALDYIFQSDRTLLPHDSTKSKVSTPCYKIIYFPFFLLDKPLSYIYCLNSFFCSNEY

SEQ ID NO: 23396 - protein, 84 aa, Candida albicans
LFIQLSIMAAATTSFSSGFNNNNNADQSTDSSATISKSGNVASFKTTSTTSTYQTNLTAIDTYGNEFKVPDYTIKDILSAIPTH

SEQ ID NO: 23397 - protein, 60 aa, Candida albicans
NSWIRIRIIPHISKTLKENVCIQRVAVSFLFDSLIVFFRLINHQPSTITPVSKKIMLLVT

SEQ ID NO: 23398 - protein, 81 aa, Candida albicans
SEEQKKNKPREGESGSIANKGDIDDFNKKVNSDINNKTTGVNGSTNKPKPPTQAPPEAPKKKVSIRDNTTFSLEKHWWLGC

SEQ ID NO: 23399 - protein, 88 aa, Candida albicans
DVYRKKRNLSTAHVLFSMLVTIKFFVIPNRREREQGRKKEQKKILEPIEFYIIVNIHHIKSRQNGMSTITFELELSNNERAGAYIEVR

SEQ ID NO: 23400 - protein, 76 aa, Candida albicans
INKIKKVMQNITNVAEIPSTINIAIIHTVAPAKAVLLLKYLNDGLKFGAEPTFNKKQAMLVTMNVIKNAIVINVAI

SEQ ID NO: 23401 - protein, 77 aa, Candida albicans
AFFNFNVFKKHEIGVQQTIKICARLSVSQMEENLLTPDSNPKSFISFSIQSTERTSKATQMTSSKERDTPVKNGLIP

SEQ ID NO: 23402 - protein, 80 aa, Candida albicans
FTKLIQIRFCILEDSFFFRDSFFFSLQDTCILQINETQQLQIQVVHLTTRILIQSITDYEVVILFSRYNHSAEFFFLEFH

SEQ ID NO: 23403 - protein, 103 aa, Candida albicans
HYTMIKSEVLSGSASKTVGNSISNGTTVLTQNQGGKQNLIRQQQQQQQQQQQQQQQQQQQQQQQLKHRTALQNYHFASTSEEILKKYSKYPASMSLHIFETHY

SEQ ID NO: 23404 - protein, 116 aa, Candida albicans
NTCILQRKKKRVSKKKTIFQNTKSNLNQFGKLLEELLTIKITLITVFIYGLYIIQLKLASVLRQNSIDLNSLILSLSLNTHKPYISPKRFLIMIKLSFNSTSISRIEESSKPFGKN

SEQ ID NO: 23405 - protein, 66 aa, Candida albicans
KQFLGNDSVNLDIHKNKIAVSTYIIRIPVTDKKFFKLRRAKFTLNIKEWNCFMINDYFIILKIELN

SEQ ID NO: 23406 - protein, 64 aa, Candida albicans
TELKCLSILKDQFIEYQLHQEATKTNIHCKTSVQFRTTVSAYKITPAYQRLTIPSFWRNRTELV

SEQ ID NO: 23407 - protein, 89 aa, Candida albicans
IEIVHIGSFKVHFWESLSRFKFVIVTNGEVSQLSDVLFELYLNYFIKYVVKNGLMPVEFTAEGEYSKINNGKFIEETDNYLQSLSIFRS

SEQ ID NO: 23408 - protein, 60 aa, Candida albicans
SISDSMTLNMYINKKFKKKGFLLETEKNIEHFQFLFFFWFCLFGLFSFPHTIKFFYIDLQ

SEQ ID NO: 23409 - protein, 71 aa, Candida albicans
GLANLEMGKNLSPNLTCNSPSIFSPVSRISSFLPSADMNKYLYIKSKPMNNKQLNKNLFIKSKKKEKLNRN

SEQ ID NO: 23410 - protein, 188 aa, Candida albicans
SSMLLPKRLLRLLIYLIFFLTVSLFLLLLANKHQIIEINKYIPFDIFGTAAPLFFQPPSDLFIVDISFDNCFKFSFNNKRCGLPDINKGLLGDKAQWYRLRKDICLGSSWSKKQYLNYKKIKHDKYEEYLSAGKKNNKNVVDEVIIDIAVADPVNDVKIKGNEKLKLPKHIIQTFHNKQVLTTGEDPT

SEQ ID NO: 23411 - protein, 147 aa, Candida albicans
FLLSFSFFLDLMNRFLFNCLLFIGLLLIYKYLFMSADGKKEDILETGEKIDGELQVKLGDKFFPISRFAKPHAVVHPADHHSKVDANKFPDVEPEQKQKEDLKEFNQQVLKPDINKPKVDPNSFPDIEPEAKEREAKLEAERLKKSQ

SEQ ID NO: 23412 - protein, 66 aa, Candida albicans
TLPGYPLCENFNKTGFLVVYSIFYPTGLKEFPIESSFPCYYGIAKRFSSVFNLHNHTLLLTEQVLI

SEQ ID NO: 23413 - protein, 551 aa, Candida albicans
LSDMVFHRVVKTSPLSCAPAESNSNLMVKQGAPDIFTPLMRVSPSSKSQRRKRKLSTSSNGSNQSSYSPTTNNVSPTMKKSRPANPNSNQSQKQIAYNYSINQNKNQHLVTPLSTSEETRFLNPESSYQINYKTLDNMSMITQSQGYYNTPPPTSTKRNFSTPHANQQQQHLDKLPDSNIPTPLSHNKQTNNLRGSPPLAKINEIRHESKNLLPPVSLTSHSLMNERNNNNNNNETITKNILSEQEIAAQNNVTCESLSSSDDRANINSTSRKSSDDFLFRLTIDELGKAVLSSDIFAPIASGDKHEMQQQEEITSEKNEQLVDDFSTVLTHSKVPPVLPHTKSVIGIESMHNNEVKSKAPLRRHNSDITNFSSSKDPVPQILAPINEASNNNPPSNFNNPQTPRETYGYVSTGLTPLFNLTPQFNSLMYSVMNLNASPAYKKANNPFLINQELFTSGDNAAIVQRGQHLEELAEHPRLEKLHEKSNAVMMEDLVEEKNPNNTTMDTHDNDALVGATQDITGHGNYLLASSSEDSGDARQALKKIIHVKRK

SEQ ID NO: 23414 - protein, 221 aa, Candida albicans
LSIVYSYSILKEENRNSLFSRYRYVLSFIIILIFVVVIIPDRMMLNSISTIYDRIKFDHIYIVLTLIYVVDAITKFAFTSDFTSILIQGIWTYNSIVIIISMWFIIYSKDTLFSILKIIEQDNSQNTSFVTSFIISSISQLEEDYQLCSQGKTALEMCLKERNTDNLQSYFIILKTMVTNCWSILNLVSFVLIPTLISCIYNRKQLLSNIKQFEAKADSVV

SEQ ID NO: 23415 - protein, 68 aa, Candida albicans
IPFSYALFATKICKYTFARFFERIYKFRILVSHLILNYCSNIMLYEYVYLTRLQSTNRSSPKMYSFLL

SEQ ID NO: 23416 - protein, 195 aa, Candida albicans
IVIYLLEMTTDKEIIDNKTIQLLELLDKYQQLTTLNRENFINGFFNLSRANFQNEKEKYGLEKYDFRCYKACKIIDINSDNGRFELIDRLLKNESSINDDEHDSPNEDKKKESSSTTMIRNRKDRKTGTIATHDKEIVKQSNDDEETFKDPIKQFGTIVPSELYKCQQNFNNGLNQLIEIINLQIQIKKLIQELS

SEQ ID NO: 23417 - protein, 72 aa, Candida albicans
TKKWLIISKIRSSTYQDKGYLVYVCVCLCVSVISPIYYVLPCIIFVFILFIEKCYSEAQVGIKFHSIECHYY

SEQ ID NO: 23418 - protein, 315 aa, Candida albicans
RRCLPRRGEDKEMTIGGQSDFDDDDDDDDDDDDDDDDENAKNEGVDLSDNEEDEHAMSIYTSLNETHGYGSTPLAHQPPPMHSHSAVTVPTLGEFPIMKSGYPLFRGAMNRSAAANLANVFQNHSIELTGEDPNKHQPENIRSRARAHASLQRMRTRRQAKATRNVLILSQSNLRLPSLEPSNHRPQYTFSLTPIASPASPGGNSSNLTAGIAATDDVSTSSANIDSEMSPIGPQISASTGLEKYHSGERNDYFGLDDHLMATSESRDLISWKDGKTVDNKDKLYNETLDFVLRQSLKDGEIETDIERCVGVPSS

SEQ ID NO: 23419 - protein, 61 aa, Candida albicans
DYLVWWKCKIRNQLYHLFFFSVCVRITKLNFGPSLILQNFPVPHRKVEAFIAFGLQKKLPV

SEQ ID NO: 23420 - protein, 181 aa, Candida albicans
PVMYIREDYPQLSTNVKENKRDLEFVANNVRSALTGTNGLSESKSVSIDTSGKTPNKNPLNTKLKKIIIKLQRLLPIRKLLQHVKKRTLSPKEKTLQVDTDFINTNDIFEVPSRHVCTTLAIPLFSRNCIRPKSTTCVRKIVMANSQNSLFSNRSSFKSIFDKKSNITTNATTPNSNIIIN

SEQ ID NO: 23421 - protein, 70 aa, Candida albicans
ETIRIFLANYRNNGVFVFVYKYIAKYNSKSYKGSIQLIMMFELGVVALVVIFDFLSKIDLNDDRFENREF

SEQ ID NO: 23422 - protein, 84 aa, Candida albicans
FKIDYLELRSIDRKFGLFFWGLALQAEFSFQLSEKRQRDRDRKTKTVVVAALGEGWLVEKLLVVVKSLCLICTLLLFIVFYAGI

SEQ ID NO: 23423 - protein, 75 aa, Candida albicans
LSGNKLVVEGETSPYTTKNSSFNARFRNRTDGRGGESNKPQANLYEYITLLQDIYRHQEFQAIPLCDSVLKNYEC

SEQ ID NO: 23424 - protein, 176 aa, Candida albicans
GGRAAPQQQQQRPPLQSAQNTGGSVSSMGRPDLKKSILSLYASPSSSNSFIQQRPQQQQQPQQPLGMNSLSNSLSSLNIQGGNSTTNNNNVYRSSTTVNTLDKHTQRHPLVNSAPSLNNNQPKQNWNNEWTTDTFTSSPSIPSSSASSLAGTSNYKTTSSLNVNGLDDDLFKNVWG

SEQ ID NO: 23425 - protein, 68 aa, Candida albicans
RFGVVKGLGLPNPVEGCVFIEYIYIYTEDVLEFMNVNKVNQWSITHIHTHYQHILYCLISRSRRSKIL

SEQ ID NO: 23426 - protein, 61 aa, Candida albicans
EFNVFFTIVGGSVHSTKTLSMSIVENEITQINKKVNYILNLLFRKSIQLLSNCHLKYTKAI

SEQ ID NO: 23427 - protein, 169 aa, Candida albicans
SAQAAIVQSNQEPTKAKKDVIARDVDGAVGVNILSKRENNYDALVKNDELSSILPILISAISAALPEIIKIVSGLLGDSSTASSTGSLNEQEIIGDIVNEVKKVLPQAISSVQQNAGNTKRDTTTELIQAIIQEGVKLTPEIISFLQKIAPQVIEVLTKEAPQLLQGSF

SEQ ID NO: 23428 - protein, 60 aa, Candida albicans
SFMFAISQIKQCSLSILQHLNLHSRSDDENISSVSGKISLKDLLYSEQYIKINFNSRSFP

SEQ ID NO: 23429 - protein, 61 aa, Candida albicans
VIHELYSVVDKAMKYIRDIVFTQRMLGVSYIHTSKNIADVMTKATEMVITFDFSTLKERRY

SEQ ID NO: 23430 - protein, 118 aa, Candida albicans
EIKSEYQGIANLETQTMRFKGSRNGLHLMLIGEHFARLINISYVEIYRTQGYLRLSFPLSWGNQLFLHRTFKYIFHYITYIRAKSSIQTSISDTLRSIMETNKNVGNSLCLLLQPKAE

SEQ ID NO: 23431 - protein, 345 aa, Candida albicans
  UNSURE (44): Identity of amino acid sequences at the above locations are unknown.
ISCSNTTPAIKEVASSPFRTFNKMPLSEPPQSPFYVKTPSSMTXSNLGSPVINKLNQANFNAMNYQLTNSLHDLHLQSSLDSSLISLAHQHQHQQQHMHDVYHNGNFHIRLPNISHQESIYNTEQHNILNQQNNYYERSQNHTQELENGFMLSTNSIDTPKLSPVLSQSIWNSEIIPELPKVEKRENRYSNKVNNPAFIPSEHPAEAKNASTDNNSQSPKNTTLDNDDIPPPQPQNQNIKFPKQVKYTPRHNHFVEDMLNHDLTNRYSEGYSTTFYKRNKHGYMFIREATNTLHVHQNSWVQLKIKLPTTSSTVTGNKNNSSSKKLLSKKLKVNIKELPIWKPKP

SEQ ID NO: 23432 - protein, 75 aa, Candida albicans
FLGVIIGKLSQVIVFVSLLSYFLIEFLENKNIIHIPWNYFITIGKEKINLKQLFFEKPSFKISFVLSFIIAAYNV

SEQ ID NO: 23433 - protein, 61 aa, Candida albicans
IVNLTKSPLNQITCVVLYCVVLCLLFLFMFNIQIIYNSSNNNSNQFSFLFSFYLPIHYKQQ

SEQ ID NO: 23434 - protein, 99 aa, Candida albicans
IIVNLMLVYWVIVMMLLVILLMNYVNLGNYLILIIKKSRGEKNGENLLVQLLDSTLREYLISNKKNDLSSEREQNKMGEENRKVEESGRRPNESGGKSG

SEQ ID NO: 23435 - protein, 103 aa, Candida albicans
QLGFFLKELEILNYTEIASTPVVIISPTLQPLLENLSQESIARNIDSTTPTTIDNTVVDGTTTNDATSVASSTSDVAYVYIGGAMGYPSISVALGLVFIAYLV

SEQ ID NO: 23436 - protein, 189 aa, Candida albicans
ELKVIHCLVIISGFSLFFFLLIIMLDRLNRKQSKERFVNKIPISTTKIDKSLEHTRRDDESNNAKRGVNPDESYSSDTSFTPTVVSGTEDAALTRTSTNRQRQGKSSFKSFFRTMSLKVNSKTRNKDRKTKEELAAEKALAELRNLPRNPLDLELNELHVALNFNEVRKIIDDIFIDENHDAASKAIKN

SEQ ID NO: 23437 - protein, 63 aa, Candida albicans
QQMSILERNSNNGYYFFFFFFFFFFFYNLSHFHIFSLFLSSTYRVHFTLPFSHDQTVIIYQSS

SEQ ID NO: 23438 - protein, 104 aa, Candida albicans
SLQDITSIYIWLTTTYTGFEFVGGFIFTNESVDNENPFSTFVISEIVETQGGYEYYNNILQLCHSISPQAPEIQKIQTTVKKKKVSSTINSKPYQFIYKGQTSS

SEQ ID NO: 23439 - protein, 274 aa, Candida albicans
  UNSURE (5): Identity of amino acid sequences at the above locations are unknown.
EGFYXNPFPIFNISLGYSNVGSIGQIKTNDNKSQQEEHCFIEIASDFETLAIENESDITIREEFYLNLFELSLPVSNYDITTKCLKNLTLSTNFKNLMTKFITKIIFQLKLDIIFPPNNNDDDFYGQHFSLIDSIIVKVAQDSNLSQSLRVYQYLYSWRLFGCMVAVVNNNKTLELGDKRGAIEALYEFITRFRIENPTGDVERKVKLKILEIYMIILNLLKSFENNQDQWFLKTNSYKETTTTRRRSIVSLNDLKLEYLEWLKNLDEDVSMFT

SEQ ID NO: 23440 - protein, 74 aa, Candida albicans
YYSYKILLVMCCYSIYILRLFSCSLLNFHSLFIKFSNQIFVDFYWMKFSNAVETSFLTQPNKKKITRVDRFRTT

SEQ ID NO: 23441 - protein, 64 aa, Candida albicans
IFLSLPKRKIPLLTFSYTMQLFKKVSKESKGNKTSRHNQQLNSPEDLTKKNWFWMLIAGICYNT

SEQ ID NO: 23442 - protein, 64 aa, Candida albicans
LKKSHNIVFKVVTLLNLREKRKVITFLHIKTTTIGFNRFSYLLEIELLMTLLTLMGNPNRHRKL

SEQ ID NO: 23443 - protein, 73 aa, Candida albicans
SFISTNERGQFKVVFPSTCYFWNKLLKVCCYSLSIIPVNFVCIYCHILFDLEYFPFSYMKNKSKKKNFKVNSN

SEQ ID NO: 23444 - protein, 157 aa, Candida albicans
VSANLMHKTFISIIRKTIYQNFIVLTNYKKLDCIILCRFNKKIKTMNYLEGEVGQLTFFFYFSNCIVIDFVFYFNLPLFRKCHVSIANSSSIVLYKRVLLWRILSRILQPDNFSFNATCYVCDVVVVCKAKGVSSTKSAELIFLVLFTQAITNMHKQ

SEQ ID NO: 23445 - protein, 80 aa, Candida albicans
  UNSURE (3),(13),(24),(26),(31),(34),(35),(43),(44),(45),(67): Identity of amino acid sequences at the above locations are unknown.
VTXSSTNLFFFFXLYFVLGPPPEXPXESIEXKTXXGPGGEKGXXXEKIFGVNFLKPQSPPPPHTGRXWGWGFFNDICFFS

SEQ ID NO: 23446 - protein, 81 aa, Candida albicans
INEPKSPELVIIAKRENSNVQECRLVNYAQKRESNVSLILLIDVQYDARIRKEQYEINPQLQQAQLPAKSKRMRIKLIKLH

SEQ ID NO: 23447 - protein, 158 aa, Candida albicans
ESIPKNILVEKKKCKTVVKIFKRSNLSSYIQTVFSMLETKILRVLPQVRRYLVKRFRSPFLFLPNETKHIFDEEKLTPEENKAAIPLKPNYDNLEKIHHEVINPEEVSDLVVKLNSNDILVSILSKDGYLFGDKNYLLTGTNKPTRFKATSILNSWCR

SEQ ID NO: 23448 - protein, 444 aa, Candida albicans
  UNSURE (10): Identity of amino acid sequences at the above locations are unknown.
RLFTRNKSSXNMSIHPFQSDDDSLPKTLREFTSPSESSKSTSGNKLRIAKKLKFPKNQSSRKPDMFLDTSSTISEDSSSFRKVIIGDLLNEMTKPRKSSMSSPMSTTFHSLFHRSHHNGSNLQQDTNLAATGTTPLSGKFDDFSKASKTTLCLSSNSSNSIISNPELAQIYNFTNPNISIEDGETNLDHSNSSFLDIHKKMLVPADLFIQNKLNKYHQTEVGLGIYESELDHDKDNKIYSNLYHYLKPLFTPSFSISDSGQKGKRRPILSTSVEEIANFVKENFCLHQPDHDKSFRLKTRSSVSSLGHEKVEDFDYRQLSNLFEKLMALLSHNLQTADSSKVSLQALILNAWKYYNAYVRFYLLSIFQPLQLHLNELSMRGPNGSTVTRIDDLLLVSFRKVFITEQGIGSGDRETSQFLGNAESEDLTGNGLLTSTLAVLSSIS

SEQ ID NO: 23449 - protein, 62 aa, Candida albicans
VPVTISSNQTSLEETVVAKQKMNNYLLLYNNAKFTTNKRHAYYCLYIFSNACGGIVILLRLL

SEQ ID NO: 23450 - protein, 68 aa, Candida albicans
ALLSVGVEAGEESVGDEEDVEATDELVDAFNFLSSSILVSIIDESSSTEKLLLLELVTSEVADSGVGI

SEQ ID NO: 23451 - protein, 61 aa, Candida albicans
NWFAHTKVSLNTIIKNVQQFFQNKTTSPSQLAAEVDNRESTGSAKALIISIIILIALGVGS

SEQ ID NO: 23452 - protein, 77 aa, Candida albicans
QQQQQYYNNNNNTITTTTTTITNHSIQFNKLKVTRLIVCGKFIQSGLFICIESYVYSESLNCDHFNLVSQLITFYNI

SEQ ID NO: 23453 - protein, 75 aa, Candida albicans
INCIFVLFGRPTTIGNESISHKTINQEVRHPYFWHLFVTCQTATYTHPIQNPPRRHNEKGKDHRSFINIKCITYD

SEQ ID NO: 23454 - protein, 83 aa, Candida albicans
YIQSSMISAIYIIYLAEKQESNEFSQIELLVNRRYHQTLPHDEIILQNFHNLMTNLPSSEQVPVLYYDNLSSPGRLEAPNLRT

SEQ ID NO: 23455 - protein, 422 aa, Candida albicans
DHLKKNVKKLMNGNQTIKKDNFNDCNDNNNNNNSDIVVNDFSNYNCVNNNNIDANIDNSDNGENAILILPQYSSTLDPWNTIDFTSKFSMSHVTENRSTSVDSTKSDVQLQLSLNYPLKNLSNSNSNSNSNSESNLNSNLNSPIDIVSGSGSVSVSVNSSKTSSPRKRKLDNKNFYKVSKLDFSNLNIISIPDYEYSSQLSNHSFRVPNAYQCLILEEKLIESINNSTTCRVQRTLYTRDGLDKLARIHFHGDYEISINPNFKKTSYEAQYILTKLDKSRKPDNTTRAGLCPYCETIEFFGLKNSSYGNHLAYKHGILTNGCSVPDPKYYGKYKFKKGEYDEPEKKKRRTNAHILEREGVLCTNCWQILEVNCTSRSSVLGHYLRHYRDSHVGNKKEIKIDDEDPLAGFDPIVFEFTNKWKL

SEQ ID NO: 23456 - protein, 84 aa, Candida albicans
CIDKSQLVSLIYREYERYTSFEILFKSMNHIKSSLSILKSTISPMAFFTDILLSFTTMLFRFASSNKAFKHSDNVSLWFNTQES

SEQ ID NO: 23457 - protein, 175 aa, Candida albicans
MMMMRIYVQYQKSIHPFPQEKEEEKKEETGNVHHRKQHFIGYDYYTIPTIESTSSSSSSSSSSSSPTYFDNQNHNNSTHHHHNHNHNEEKDCFVINDNNYFTTWSMNRNNSSSSGTTSGTTTRTNSTSTRHNSSSGNSSGSSNNTSRGSSIGSIFMDNSIQYFNNKMKKFKFGSN

SEQ ID NO: 23458 - protein, 81 aa, Candida albicans
RSSVINTYIHTYIRIQQPTQPTQSIHLRSSRLCRLHLAQIVSSSPPPLFHLFFFKKKNPTVNGYMYNYITITISIVNSNSQ

SEQ ID NO: 23459 - protein, 60 aa, Candida albicans
INEKISINVETYDYHRNYSKLNLEIEKTNVMKLLFANSVEIIVHASSDLNFSKSSYPKIN

SEQ ID NO: 23460 - protein, 85 aa, Candida albicans
SSNWVKLELTQVLLLHIYEKISKLTKVTKIGMKTKLRISCMTTPIFQIEAMNIQTNSRENQWLVTNTKFHSFSKYNYIFSCLVTL

SEQ ID NO: 23461 - protein, 60 aa, Candida albicans
IVEFSYLQLHLEGYFTYVDRFAARSVLYSFIYCLYNIRYHNRLTLLPNFIVIIWLVQPNS

SEQ ID NO: 23462 - protein, 91 aa, Candida albicans
HCILSSKPSNLKTLKLYKRCITSSKDYITINSRVSSSINKRVVKFLYYMNHTEQFIVAGSFFKIQIIKNTYNYKNYRNKLIKLTTHQIGGN

SEQ ID NO: 23463 - protein, 65 aa, Candida albicans
TKIRSQENTYTIIQVKPQSVEPSQQKDFENRAAVFIATKEPISQLANKTNKRMEGYDSFTKDVCQ

SEQ ID NO: 23464 - protein, 74 aa, Candida albicans
LTKRTNEWKVMILSQKMFANNLLATIVESLCYIKNAFQEAKIIKEGGLKNLDGYIELDETTTFVYICLQLLMKL

SEQ ID NO: 23465 - protein, 355 aa, Candida albicans
EIRRQMKIFEALLELQNTLLKYYLATIQYLYHELLTLFENKVSIDVEKPDLERISFYTSLIEKYQYQIIQLTDFNKGHTIYMTLQQIINSGIQDVLVTITALRNLEQKLIRVSSEALLIQPGIEEKLKWIINENNHLHNFQNDQDKYQAFFARLKNEINDVPPPQYTCLSLNKFVEDIVNEYSLDIPVLEIVIDKLNRNHSEEELYLEKLQNTILQHILEQEVDTSSVSFTEQEIKVIDIMEILTAHIDFFKRLSKMYIKFDKLLLQKLRLDNLPAPESVEINSHIAKKLDNFIANLVAGGTVGLSTEQTYILVFSFIQNIAFQFRTFNENYIGYIPASRPARYGCQRRVKIKLG

SEQ ID NO: 23466 - protein, 97 aa, Candida albicans
FCFRNLRASVDHNGHKNRYKDLRSFDCIYKIRMTNEMKSRSFLEINNTLLKKGINILDYFDLKIVLQPVQSGILAKLGDFHHKWHNLLKTRGLSDIG

SEQ ID NO: 23467 - protein, 146 aa, Candida albicans
VHIMQKFIINFANIHCDKCEGIIRNFVSRYYEISDETDLNANIKPSEVIFKLENNEVTLYGNDLIDFHGDIKSIIKSLGKSGFDILSWDLHNGDETVSSSQIVNTNIQGANEPDGFIDIVGMYHKFINSRHKKKHIFHHGPGRTAC

SEQ ID NO: 23468 - protein, 62 aa, Candida albicans
PARTYLKKVEENLVAQQFQFFFCNKNKTTHVYKSWQFLPISPRYRIEEVIDITNNVSFQIIK

SEQ ID NO: 23469 - protein, 83 aa, Candida albicans
RRLSISLTMSPSKLSNDETPPDLDFRFTGIKQRLIKSENVKQVTASWKRLLVEINKEFTEIAKIGPSYVPKCVFTTGVEDPRL

SEQ ID NO: 23470 - protein, 95 aa, Candida albicans
DTNVKGAAGHAHHIQQQQQQQQQSQHQAQQQMAPMPSHGLPTHYSNPQGAGNPGVPPQQQGQHQPGIPLQGGYSDQYLYFGNIQNNNIPNQQQYQ

SEQ ID NO: 23471 - protein, 66 aa, Candida albicans
EVILLPLFIPYGPTKFKNYSYSTRKLNLTIRLQGKNKENIENNKNWQLISQYNKPEKSHFLIYSYL

SEQ ID NO: 23472 - protein, 66 aa, Candida albicans
ITFNNNNTPNDELIIIIIIKTITNNRYNTFNYSPKSPDLWPNTLFVDGRGAGGGNEKPLATRKRKK

SEQ ID NO: 23473 - protein, 82 aa, Candida albicans
  UNSURE (15): Identity of amino acid sequences at the above locations are unknown.
QNLTPVPKHTQTHTXTFFSETEKKNFKQKFFPSRFSFFRISSNFKDACMYNNSVIMMSFSLLLGDYYNKWQMRNILDNKPCK

SEQ ID NO: 23474 - protein, 61 aa, Candida albicans
RIDFSRLGFYCHCTWRQTMATLDENNPSKQTHRHWSIENEIKLFSLLCDYKPAGKNKQNNI

SEQ ID NO: 23475 - protein, 72 aa, Candida albicans
LHNNGCEKKKETVSQHNSISIVKKLEFFQKIKFSELNRSVILLSNIFPPTCSFLKLNEYKKKLVEKERIITC

SEQ ID NO: 23476 - protein, 61 aa, Candida albicans
ILRQQFLNYIQNNNKNKNNYTSWCKINPKWANCGSRKKIQYNTIENTVYHLQDLTKNKKRE

SEQ ID NO: 23477 - protein, 60 aa, Candida albicans
KITESTQQLKKNIHLYNKTAKRSNYYSNNHNARSKSETVLSDHVVDLIESNKLLSLLVLC

SEQ ID NO: 23478 - protein, 301 aa, Candida albicans
  UNSURE (297): Identity of amino acid sequences at the above locations are unknown.
LIYQNNNCFNKVFLFKPTSIRSLHIFLTILCLFFPSQHVLFIHSFVRLFTSYFLVTLLNTTMPKIIYYDVDFIEFDNIITQLIVETCQSHNSLDIHQIIDYFHYCFEVYVVVNQQSLRISSQRIDTTLEILESKLFMFEIPVFIKDAIREMARPMITAKTSFGMNSANNNSNIYLPNVNIISGKQYLKLFANNRYKRLINNLMSAMDLRKVYWHHLEIEEIDTLGFSMYHDEKNLISSFTALPQFRFLTVALLKHIRFNQFRLVNDSEGNKSNEISPGWINLDRGMKNQPPITIDYXSDTP

SEQ ID NO: 23479 - protein, 211 aa, Candida albicans
ITTNSNFCSLKMKNLVKETTELDNISRALVELLKKNHDSFKSLFNVQLDLLKLFDKQVNNLEATGYCDYEVAYALYMIIIQLIAVMKDKSNSKTADIYNGIQQSIRKKASNFKKVLGYFKNDDDEKDEDPLINRFKSLSGEKTHPATKIKKELIYREWITPVELERTLREKHVLLIDYRPKKDYLHNHIKFDNLINIEPRQIESLPESSTD

SEQ ID NO: 23480 - protein, 109 aa, Candida albicans
  UNSURE (24),(26): Identity of amino acid sequences at the above locations are unknown.
KFAIGIIMLLTRLVINGGQKQVAXYXIFIPVLVNSVDGVDNLYLHEKLIVLVRQSASSFKQVVNKYLDDNQKKLTEEIVTSSVAKNTVANQSVDSFDQVPEIQLKTFGV

SEQ ID NO: 23481 - protein, 147 aa, Candida albicans
SKRGSWQPRGEDTPNLSYLGWLQLIPIVLMALVTSMLCFIERSISSRKFFESEYRYANDDMRIMRKTYVDEFWNDNASDDGFYVYTDGFYTRNGDNVQQPTSNTAGSLLSEHHDVSIVEPRTFLDTDDSRRGSSPHEFIELQNLRPV

SEQ ID NO: 23482 - protein, 117 aa, Candida albicans
LLCFLLVLVFLHQIYALFHLGETERGIESVLPGISLPEVMILISLFLAWKILFRYRSLGLVFKIFHSSFVYFFLHQNILPNCFFQSSCQNHFNIFTLTLNRSANNDFQKNYSIDRIV

SEQ ID NO: 23483 - protein, 420 aa, Candida albicans
KVSSMLETRILRSLPQVRKYLVKRSRSPFLFLPNETKHIFDEEKLTPEENKAAIPLKPNYDNLEKIHHEVINPEEVSDLVVKLNSNDILVSILSKDGYLFGDKNYLLTGTTKPTRFKATSILNSWCRIFNNQIKDLKEISPMQFWDPVVSPQISKAIEEYGDDFEKLFQETRALKNSKLKKHGDIPPSELVDMITVDNLSLYVLNNLSSIESLAAFVGFMRDHIEYYTVEGLSEILAKLTDICYRLHGDIDYELYLSVKQKHPGVIQKLPSDTIDKLANLLASKNWELSKELIQVLIKRDVCPSETTMNEFLLNFVNSDPETKLKELSFLKLAIFSRGVNELSLQIILTTIRNIHEFSKLIELIKSSNQCQLILSKYQHILFATLRRVSTNLPLQKAQFIRVLTENNVHVDNDLMRVLEN

SEQ ID NO: 23484 - protein, 204 aa, Candida albicans
VNSFKLVHSFMFLVLQHEKNEIQKTALEYIRLQLIHDLLLKNLGYGHINYDIDELNEVRKSVYTKYWLMNNVETCCIINPLPTYMNIITQNQPTLQMKLRCHDQTSHTNLLNANHHANKAVKIEYIAKYQLFDYRIIRVGPEVEILTKPGLKDRLRRMVTRMKSKFKSPISPIKKKIPDKASKGFKTAHRKFLSYELQRIRAAT

SEQ ID NO: 23485 - protein, 92 aa, Candida albicans
  UNSURE (32): Identity of amino acid sequences at the above locations are unknown.
GHPKIPFKHSQGDRDLNKGNIMLPVPTDVESXMNIGQNISDSYYDPFINKLAKNKQYLGGGWRLQNVFQQALDEAFIGLGCNIELEKATTIT

SEQ ID NO: 23486 - protein, 78 aa, Candida albicans
QRLRRRPNTINYLMLYVTRNKLTNAPSQKNITIPYVRKESFYKNKQKDKVSNNTMNLTYEIVVKVFSFYLAPLVFSLL

SEQ ID NO: 23487 - protein, 278 aa, Candida albicans
LRMAASPEKRIDAKSNLNQIKSQLYESTTPSSGGSTRDIIEEQKFENDLDYLLTNKENGNYEEQTEFVSTKYDEVIISKSTETKNKSKPKTKNKKFTVADVTKDMEGLDFSSDEDVANGDTIDKNKEEKPNKLKLQKSRSRLNKKKSKSKLNKTVGNGSPVANSETPIDFNLQLDANKEATKPKPKKSPKKKETESGQPEETQGNKTPKKVRSKKSRNNLRPKAQSDVKPTDATKTNEDKSIINGKNGNINKETPDSKNNGIEGPELVDLHHKLVNPR

SEQ ID NO: 23488 - protein, 73 aa, Candida albicans
SSVSLYDFMIKLRRFGIIGNLLSTITFLNAPLNRSETLYFWDDFCGVIVSIIGILASIMARKDETNEQLGKIS

SEQ ID NO: 23489 - protein, 246 aa, Candida albicans
  UNSURE (20),(30): Identity of amino acid sequences at the above locations are unknown.
MENGTQISMVGTGLCSTYIXNPQYDIIAKXTTELIMGMHGQGQINFHLFHSSSDSMGERIQNFDKTKLINYQNYNASYQSLSYRLTPGHYKLVVSEYYRSIGTYQLVLNSSEPITITKIPPFLGLYNISKSFNWDNTNRFKLKFETTGYNSKVKIKIAYFNGESDFELQTSYRPAMRASLFNSQTKQPIQINEQFNDSLYGVFLHEILPLPEEYILLIERFEIGYGRCVVEIGCNFFTTAAGRNSA

SEQ ID NO: 23490 - protein, 63 aa, Candida albicans
SFLECKTSSEWKKEVHNGPLYNYLDMVGNTTSQDKRNFIKLEIHIQEKSKQSSSPRDSRSELC

SEQ ID NO: 23491 - protein, 86 aa, Candida albicans
TSCNMSESDTSEVDISLSQQSPTQLPQVSQDTKPKKKSVGFAAAPEEDLKEHHQLLKQKEEIKLKSSPFHKIPAELAYLEEQKSQN

SEQ ID NO: 23492 - protein, 60 aa, Candida albicans
GFFFFFARIKDIERNTSKNVEFLAIQTRKYTKQYNTLRHMTSDIFFLQQNEIRAIALTCD

SEQ ID NO: 23493 - protein, 186 aa, Candida albicans
EYRKLVLIEKFDYDEFFQLMEWVLYFMQDFLGKENVPLPVNNKNELVILFLDSLKLIEQKISQSLLPSFAKILQGLCDVVNDGVKSEIDPETVQKLDAWNKLLNNVHGTKKIFELPPSLDDLLGLSPSPGPIPETTSSNPMKHVLDDDDDEEEEGVRRKQHHSSDSKTYILKPHKNWRPVPFGTCI

SEQ ID NO: 23494 - protein, 226 aa, Candida albicans
HTLIKFNSKRTVQKGELKYIGNKMLQQKQISKILQQGLTPITLNSKSNSQSATTIPTSTHSIKSISLLSKQGIPLITVSSTTDSGSGIIDQDYKIYSIIAYNSLNKPNENDNDNDNDNSKNTNKLKSKENETWTIIQFEPGLKCMIERCLDMYLVLYYDGRVDNKDRDAGTDNKNNKLEGAANGDAGNVKTKETRQLEVEVDAFVKLKMDGLVLSLHDGLLGYNNE

SEQ ID NO: 23495 - protein, 64 aa, Candida albicans
VYMTVYLDIIMNKRSFVEQENKSIYICKHLSRIYANFGIYKTKTTQIRQQDKKMLLLELLNNRN

SEQ ID NO: 23496 - protein, 61 aa, Candida albicans
IAFNSRRNKIGFNKGQMFKQYQFIIMPINYLDGLASSLDQVLFNQAGEYRSTHSILTGIDS

SEQ ID NO: 23497 - protein, 70 aa, Candida albicans
PSKSMYIKKKILSIHNTKYIYKIIHGKTKKKKEIREFHKHYSSSELSDDASSSEDSSWLTTFINPLSDPC

SEQ ID NO: 23498 - protein, 397 aa, Candida albicans
ALAYREMYRKSIGEIRRSSLEERLNSSMTNDSLTTGIRNGAFKSSTNRKFSTEFNLVDTKNQQDNSVPSLNQENQLDDTQSDRFDQQSVPPLRKRKSWFAGVLRRRKPSLVNDIQSAPPVQQQQQNNKSKSWLFKSKAEADSTLVLNTAQYSNIRSAESDQAELLSTGSVDRNNKSNSIQFESRNLEYDDTIPIFFGKYSGSPMCTSILRNTQIVYFQLSAYNSLYDFDEDTYHPWNIWEVDEDMKKLRGTIDGKDDFTEFAKEFEYSQVLLMRSWLVPNYEIFKNGYLIQLKINHKKNDTQKAINLYLSCSRDSIFKKLPEQGVRISVCGIRYFKKTLQLSEVIFWIHPIKNMSFSIIEQVVLLLKLFKITTSIHKTILVDLNNGSRSTIKSLYTY

SEQ ID NO: 23499 - protein, 61 aa, Candida albicans
MNRTQKETCQMLLEIQRNLLFINNVIISILLLSYYYNLYSIIPLNILNTIPTKTMVYNFGF

SEQ ID NO: 23500 - protein, 64 aa, Candida albicans
QLSLHPILQRVDKFDNQSKYYNVKSITIILLQINQVMDLRFSSTYESCKYILRSQLTYLKRSSK

SEQ ID NO: 23501 - protein, 246 aa, Candida albicans
KPIIDITFSLYTLNCLSSFHQILVSYNMTINNYFQLTFYLVSQYINEIYPTSEGFKQVQFTDDTKLKQVKLFKGEEQLLILSFTEISETQSLVNLLNIVGRLDNALINWEWFITDSDYTVKFPIDASKIPQDLIDKFKTKFRLIVDDEKVSSIFSNTPKGPIIEEHTDSESIRSPTPELPYNPVATTATATQPQPQPPAAAHPDNSIFTGSSVFTTKRPLDMPDFDDEYEIQNPFYTAGWSTELAR

SEQ ID NO: 23502 - protein, 66 aa, Candida albicans
YLNSFFNSRENVITTTTIISCLKILIFKKYILSIEKDRRGKQAKDLIVIQNESKSKLKLKHAGEHN

SEQ ID NO: 23503 - protein, 85 aa, Candida albicans
NYYKKNLAAHNTRSKAESRKSFFSSCLCFLIICNYSQVKSGHQMTSNSCSVLTNRLIRHCSVTSWCLRPRKSRSDYKYSQRLEIQ

SEQ ID NO: 23504 - protein, 68 aa, Candida albicans
LAAAQHGTTSTPSHYDKEKISTPSPNFRLTVINLEQVNFLFFFFWQFPKFGESFTVLGREGFTWLIVA

SEQ ID NO: 23505 - protein, 80 aa, Candida albicans
  UNSURE (10): Identity of amino acid sequences at the above locations are unknown.
YTYYLLGGLXNNKVVKSCILFKNKPIHEFYFELKIPASSCLINPLFFFPNPSLKMGFKNKPGKKKIFPPPKEFSRAGLRV

SEQ ID NO: 23506 - protein, 129 aa, Candida albicans
HLRFYDTEPYTSDKFDVSRFATLQLAAENKNLLRVAVLNTRTQIWRFMRYYYDVSQAVSDTITYQPYFTNCRFSHIGGSACINGKTITLAQGLANIAPEHKKDMDELRKQFPIEELLWGGYLQITFPGL

SEQ ID NO: 23507 - protein, 80 aa, Candida albicans
LFLILRYNYIYIRSTMKVRSKSKCNIRSYLDLLRLYTHLCFILSKDLSHQMSLVNQNTLTSLYESIYYNKLFCTCFFSYI

SEQ ID NO: 23508 - protein, 98 aa, Candida albicans
IILSDLDSLSNNAISLASYSASDIECFSIQAKTGTKKAVTIHLGYRKSILSIDVDLDLASYEILDQQLTDGPFSSIAISPSGQLISLFNPTIKRKYLS

SEQ ID NO: 23509 - protein, 80 aa, Candida albicans
LFLIDYSLTSLFYIENPLLITMSELKNGTSEPKKNETTQLDSKSKSTSANKSSVPPASLVPVQPTALTSRDKTTQRLIVV

SEQ ID NO: 23510 - protein, 108 aa, Candida albicans
ANTSITMSSSDDDFDDDEDDVLLQDFLLGKTQIPEVSIILQTRNPLPAKIPQTQQPNTQVKKTILDDEVQAKLFQADGEIATLRAQLQQLQRQKQEEVSALKESYEYI

SEQ ID NO: 23511 - protein, 130 aa, Candida albicans
IQQQQHHPIILTTMSIAITKFFNKLKKAYNLFYYSSPLPVLSNGEAMAFHFVNLTILLISVYYTIFYVPKLLIQSTEKIIYYLTGQQVYIFGLLQSGLKLVNHAATHNNNVTNFSFSSSSSSASLVKNQF

SEQ ID NO: 23512 - protein, 93 aa, Candida albicans
VIRSTTITTITTTTIPFDPEQHYFTVRFIKKKKKFRFTISYGLKLINYSFAINLSIITNTLVKTSKKKNGWMERLVFPAVHNPQEFDFFVFGS

SEQ ID NO: 23513 - protein, 204 aa, Candida albicans
LKTNLYRKGGEAKKKSFIMRQRTTIYNPYSSHDGIITNLNRTNFQLSSIRNHLFTIENKYTITITTTQPNKSSLYLAIKELRIQTKFNNNESGIPIFSFHYKPGLNIYAVPQSNVDKLEFWQQVEQLIMELLGIKLSSQQWIANVNSFYYHDIQPQPLLNLNLNLNLKEGWKFNLHPKSNYDYIYNQDKIIIRELLTNVSEIEF

SEQ ID NO: 23514 - protein, 92 aa, Candida albicans
NKKKAKAQTKADDFFADESISQIQYTNSQSHLGSVYNLNLHRPINIKLCQQQHQQVIAIFLEEIAIDSETDSEEIGKVTNLTELFFWIVFQK

SEQ ID NO: 23515 - protein, 64 aa, Candida albicans
IVTVSENPRPKSGLVKGARFTLFPKPAQLFCFSKSQHIKLEAARKSWPEGNSQPQYLVKSRYEF

SEQ ID NO: 23516 - protein, 105 aa, Candida albicans
RLAIFTSRLIKDLQCRNVGTHSPRPSTNFTSERDLPSNYCSITILLNGFWCIVNVLQLPTGIKHTSVESLLQYINTTTTPFIKPWLSLGYTFILSTFYNPQFTPP

SEQ ID NO: 23517 - protein, 62 aa, Candida albicans
SCHFFWECFNKSNSNVIINFLFLHQIRRVKAPRPNFFFSGLSLSIVITKREKEKSEPSYFYQ

SEQ ID NO: 23518 - protein, 65 aa, Candida albicans
LNERLIKLLAQREKSLPPLPHTRNERFKFSLKKKEKSKIENLDIIFPFNFFQKSNLLSYINIHGW

SEQ ID NO: 23519 - protein, 82 aa, Candida albicans
LISYLFPSIHPFQLIIIFHGVSDFSNLIGVFFSFFRCVKIEISRLSMAIVIVIVNDDDEYDNLTGYMSINKQYLNVLSILFL

SEQ ID NO: 23520 - protein, 66 aa, Candida albicans
IVDQSEWLLCIFHHNQKKPLWPILCLVLFFELWGVGHMQAIRSKTFEKHYAPLPPPPPTSTTTLKQ

SEQ ID NO: 23521 - protein, 94 aa, Candida albicans
CFIYFIFVSQTLCTRKSGRMDQELAFVSMAKFLFIHTFLILFYIKIKIYDSDNTIGYYYLFDCCNSTSSFSGISIYFISSRKYLQFLLKISWAN

SEQ ID NO: 23522 - protein, 70 aa, Candida albicans
WFSNQFLKSYAQTQNEGRNKKKGGEKGANPRYLKGEKGSPGGVNISTKCSNHDSGFLKDNLHHGAGRIRA

SEQ ID NO: 23523 - protein, 71 aa, Candida albicans
KHQLIGPPDLDAYDCNLSLNNPLILFRFNKPQLNIVHMIKLQQTDELQWFQNTITKNTKESFEKPIKLIKC

SEQ ID NO: 23524 - protein, 74 aa, Candida albicans
RRFTKRAFNTGDTICPCMIKQVCILCNQKEATHYKERIDTLVNQKLRKIRFPGPRFRLDDFRLSFLVTYLVCFS

SEQ ID NO: 23525 - protein, 60 aa, Candida albicans
IILLSYIFGLFFLNRFCPSKRRTNNTLVITVALSIRRIFRKQFKKWLKLNLKIKVPPLTI

SEQ ID NO: 23526 - protein, 70 aa, Candida albicans
NDEGLVEITVINVYYFKKDRIVLSSHKLYKFKVCPPDNDEANKVHTIIMLFHHLSNYNFFNELKLLVEEL

SEQ ID NO: 23527 - protein, 68 aa, Candida albicans
NLVQGKKNNLLNLEEEGEEVGRRSSTAGVKICRRVKIIPLVPNPLTNPHVLSHRFDLIIDNLLTTLLL

SEQ ID NO: 23528 - protein, 69 aa, Candida albicans
SLSSGNDISLSSSSSFDSSANGVETGDEVLSPKIEGPPDPSLANPELVDPDFANPEKGLPLDWANAELA

SEQ ID NO: 23529 - protein, 147 aa, Candida albicans
  UNSURE (20): Identity of amino acid sequences at the above locations are unknown.
PTYLQKFKNVLGEKVKLDRXYSQLGMAADQNSANKDVLKSRPLDFKNDLMQTKLREKLNNVRSLEKKVLALLMPIKAKNSMDDQTIDNIERIVFQINEQILDHSVGIDDLATQMGELDIEGDKKVDVLSNCSKLKLRQKLRQKSIMF

SEQ ID NO: 23530 - protein, 103 aa, Candida albicans
AILNRKVQLAMITPITKECIYKWANILKAKPTLIKDTFSIGKYNNLTNLLNSILQINHHPTVNKSWFQGFHFVFNNQLNTKLRSDGYDNYQAPVNEQGEQLYL

SEQ ID NO: 23531 - protein, 68 aa, Candida albicans
  UNSURE (67): Identity of amino acid sequences at the above locations are unknown.
LYFPVENSLQLVCGEICVLLAQSSCRSKYESLVDKSQPCARTMSHAINKKKSADSSSICVRLPACAXQ

SEQ ID NO: 23532 - protein, 181 aa, Candida albicans
KNILTMDSIFPSKVEYKQIDTFIALCDGLIYDTTVDEIKDVIAPDFPQEKLQEYVKTFTRPSQTPGFREAIYDTINSNTTNASRSFGILCNILGSRILAPTLTNSLTPIKDMTLKERETLLASWRDSPLAAKRRLFRAICALSGTTIVRLASELHLKAIHFPQRDLRETAYEGQVIDPFRY

SEQ ID NO: 23533 - protein, 62 aa, Candida albicans
APIYHIHIEQGNEKYINAVLLPSRSTIQNIQTNAAKAFNIPKIPVDNNQAFSPVIPNDAKIA

SEQ ID NO: 23534 - protein, 92 aa, Candida albicans
RSGSMQNRGVIPRNNGQAPLPQPQNGARGFVSQQQQQQQQQYQYSYLPLGASGQPKQQQQQQPQQQPQPHRGHHPYGAQYTSQNPNGQARYY

SEQ ID NO: 23535 - protein, 312 aa, Candida albicans
LMKFHMRLQKKIFVLEYYIKPDISSFSGKYLFLLFFLFQSHINQLFDYIYFIQKYLICYIMKFLTAASLLTLSSSALAAIKDIQLYAQSSNNEVNDFGISSRHEGAALNYLFLAAPGVAENLKYDDETKTVYTELKAGSSTVRQPLNVGNTVLQLGGSGDGTKVDIAEDGTLSFDGSDSVGAAKNINDPYNYSKDSYAVVKGGDGAIPIKLVAKFTGDDKESASSSSSSAAPEPTASSSEAPKETPVYSNSTVTLYTTYWSLSTTITLNVCSDVCTPTVIETSGFSPCFFPSSSIQECFFRKLLHQKNTGES

SEQ ID NO: 23536 - protein, 61 aa, Candida albicans
KVFHHLFNLVFSRLTPHFLSEKSTILNMVIHCPKLEQATFVPATLLLLRGGELQRACYFQH

SEQ ID NO: 23537 - protein, 151 aa, Candida albicans
VLCFFLNLNSFSYYNLLNYSSLKSIMKPPQRKEYNIKNNNHNHNQSKSNTNGNGNGNGNANSNTTTIMNNNRKSSMKKYRSIATQTLPNLSTSLQLSNYNSQYNDVNEYKYSNYSYYYNSLDELFLQFEYEDPELEYIDQFIKEKLNITNK

SEQ ID NO: 23538 - protein, 71 aa, Candida albicans
IRSFLNFFPLTLFLRPKPNKQTIDKFYYSFLSETVLCLLGAIIYLFFFYAPMMNNLLYNLYKLMIFSIENH

SEQ ID NO: 23539 - protein, 65 aa, Candida albicans
SNFFISLKDNTRPKYPRNSNAVPQVQATLNHQYRDLIHIKQAMTNVIANNTKNNILAVRFNRGIS

SEQ ID NO: 23540 - protein, 63 aa, Candida albicans
TPFPMGLFCGYRYISLILFILSHVYIYIYIYLHVLVSSDKYIYYNYLRKICNSQITLITCISN

SEQ ID NO: 23541 - protein, 60 aa, Candida albicans
FRGNRKNHGIFLFRIISNNFFLWVQEINNIIKKKTVNNILLTGIKLNYTTNIIYFFDGLG

SEQ ID NO: 23542 - protein, 75 aa, Candida albicans
FKFSTVSGNSIAHWIFNTFIRIIMRTLTHVELQVQMEFGILPNKSVQTRYWQNLTNNGVQYKAKDWNLSKSRSKP

SEQ ID NO: 23543 - protein, 60 aa, Candida albicans
EEDTNTRLLKKEKKLRMNWPCKYPIKLPIFNLLFQIDTDLNVVKNDGICVFDIEQCMLTK

SEQ ID NO: 23544 - protein, 146 aa, Candida albicans
  UNSURE (98): Identity of amino acid sequences at the above locations are unknown.
PNQNILFLKTITLNLIMNNSNDWSFSLCDDSLELFDAIEEEVGDNDTTIHPKSDDSNNGDKCTPLNQYNPFILTKMNYFERKHPKTKLKMFDKKIKVXATDILKNIGSTPPENLNWDFTCSWIHRKGIPTEILKERCCNRVVNSEN

SEQ ID NO: 23545 - protein, 64 aa, Candida albicans
KTKANIAHTINPILQTKPKPFNQNGPCLNLFLLNTKNTVGIKYESNKKVTQEIKMELYAVEEPK

SEQ ID NO: 23546 - protein, 322 aa, Candida albicans
KINDRCHFPTSQQQQQPQQQQQQQQPFVGIQPGLLQEQQIQIIQANQKRMQQELQQKGGSFSQGSPFQKSHTRGGSGGGVGSQQDTFNVNPGPPLSFRFGAGSSTISASGRRPLSPAKIGAAAVANLATPTTPYRGSSSTASTSTRRSAAHHRHSSLPLDTSGISHRLSSVTSGPESSELNRGQGLQSPLTGATSTLQVKPIPARPLHKQSKLQVQPLQESMTSFQHVIQFHHWKPTTGSPTSSSVGGGSPLKSQTSSHKRRKSSPSIPFQEQQILRPTKEKEFYAESTPKVTFENRNKDQVEMDPDLSIDSSVGENDRTES

SEQ ID NO: 23547 - protein, 154 aa, Candida albicans
YLPQPFHLLMLHPGVRLTKRVYKQSQPLLRKNEHEILLNYSKRLINTTRFLINLSRKSLIKIFKVIFLQRSTLSTFAFAYIFEVLPKLLSSVIHHLFQLKLKGLGNETLKILTDPLDSLRLPIFMTKLVATLNAFTPIYISILLPYIFNNKWSF

SEQ ID NO: 23548 - protein, 84 aa, Candida albicans
FKHGTNFESVDKESVLNILIDVITVIARYSFMIALITTIVVSHQPPQHFIFIFIWFYLGFLYLVSSLFIFWHLFTNLYYIEYFR

SEQ ID NO: 23549 - protein, 77 aa, Candida albicans
NTFIIGLFHSIEADILSFSYIVIVVVHFSLCLWFANDLHYCGKKNRMKSKLVILASITNIVLIRLLGLNFYQNHSQH

SEQ ID NO: 23550 - protein, 65 aa, Candida albicans
ISSIITLTKCFGASILLLFDVYLDQFPGIAKVSSKKKKGKTFVQKFTFSKHTATQVGTKSHLFKT

SEQ ID NO: 23551 - protein, 70 aa, Candida albicans
KIFMGWATTTTFVKKKIENVALNLVYFERQFCNNNRNLISILLFLNLYNYLSMANSIPSLERVYINSKII

SEQ ID NO: 23552 - protein, 64 aa, Candida albicans; identical to SEQ ID NO: 23307

SEQ ID NO: 23553 - protein, 66 aa, Candida albicans
FRRWSVNLPNSHISSDIHKSIMKMCFRVMCLAELVALGIGVIVVYSVCLHSRERDRMPKLVVKGGG

SEQ ID NO: 23554 - protein, 67 aa, Candida albicans
YLFYLCLSISRGCGDKSTCGEIVQDFVWEKSRDTETELRVVYPSPKIHSKFVSETEISLCNFRSVRK

SEQ ID NO: 23555 - protein, 62 aa, Candida albicans
  UNSURE (28),(39),(41),(56),(59): Identity of amino acid sequences at the above locations are unknown.
IQLVVVKIENYVTKVGKRIKIENHSWLXCSSVVAVAVVXVXYTLWIYAQCGNNAKXNNXREH

SEQ ID NO: 23556 - protein, 90 aa, Candida albicans
SCSTQLTNQKDETQQLDISIAIIHLSPQKFFTLIYASIVAKLLTISPIEAFSNSLYFHLLILLHKLYNVQISAICMFYMISSLEGTSCKT

SEQ ID NO: 23557 - protein, 101 aa, Candida albicans
NFLLSTVANLLTFISTQHSVSTVSLTTHTNSLHLNWYIYFPTTNYAKKKQNNNNSSAIDVFIFQSYFFTMQLYALFLGNSSRNYIGEEEAEIKDVQKSLYV

SEQ ID NO: 23558 - protein, 63 aa, Candida albicans
AFPRTSKEIQHQQHSLNKLSIIRAAFDIDSNLRLMNENRLQINDQKTMVAFRISRFLFCPALS

SEQ ID NO: 23559 - protein, 337 aa, Candida albicans
  UNSURE (16): Identity of amino acid sequences at the above locations are unknown.
VWSFGKRIQSKINTIXNNKFPTSISMNKMHRKSQMNANGEFIVNEFPQPKRQILQPLPLSYRSTSSPAGVGIVMGGINNANEYYPKVNLQNRNFSLPTNFYNVNANVNNNNNNNIGDGNNVNNTVNSNVTTNNNFNVNNKNNMNNSVSSFQSGSVSTGPFNNNSASNSLINMNGNNQGNPPFFGDYAVNNDYLTQQQQQQQQQPIGVASYADASHKQQSSISSINIQPTHNAMGHYTTSMAQSYTPPSMQQMPPPGVMPNFYNGGAGLPQQMFGHQGPLPIPQQQQQQQQQQPYQQRQQPQQQNIAQPIYNNHSHNPSWSSVSSFGGGKTIYGSNNW

SEQ ID NO: 23560 - protein, 63 aa, Candida albicans
MVLEHTPVKASQNRMVWSYPAEANMTDIEEVVVYWMGVLLMSGVYLDKVIKNSSGEIGVSHIF

SEQ ID NO: 23561 - protein, 75 aa, Candida albicans
NSNEKEEKERGKKKKCPDSIDLLCVSEREKKSGRDVNYGREVEFTRRKKNIVWFLSKSKILYSSRTFYTMIYTLK

SEQ ID NO: 23562 - protein, 72 aa, Candida albicans
KELIYQEEIFVQHTVSTDNFQNGKQVFMSRKTEELSIIEEVSKCESRHSSVLSKLNYVKKEADTEAQQQKTV

SEQ ID NO: 23563 - protein, 249 aa, Candida albicans
EKLKTVCLCHMMSAKTDIPNTSSTSPSPSPTTANSTVTTVTTSSPISESKPRRLPTSETYHYNVQHHLQHYKNNNRFSTRQNLQQLKEQVTSQNNNNNNNNTSTSTPMSYNSTPPTTITKTNLDPVSSFPLSVPTTPTTLTTNTTTIINDNTKDKDNHNIDKEEDDIQQKLLLKEQSLNDIKLQCSRLIYELEGNNEPELIIKKYIQDLNKYNELKDLALQLITLIADQRKVKTSDILQEMNIEINNNE

SEQ ID NO: 23564 - protein, 480 aa, Candida albicans
TYNMSRGGGYNSSYKGKRGGYQGNWNNGHGNNNNNNSNNGPYKKSLSNYKRNGKPQTDTYNGYQGKNNNNYNSNGGNKWNRNNNYQNNQSPNSYSRGGNYSPNNNLSIEPIIEENVDDSNNNKIFKYLNNNLKDYKKSIPQESANVRENHIKNRINNDIIVEYRAICRFFLMNFDKIEFVDVNRHSIQNYLQLIVDERHIDMEEHFKQFTLLDYMVQMVKDAFKLQRHIVFDGVTEEEYNKWKLEQDALEKSKTGAPKITFADEPFEFDEQLIDFEEAFEEDFNKENSNGNANNGDNNSNDKSIDTNGNKLGTSISVLPTVIEENETDSYIPSTSKFNQHQQEQKSTVETSWDSYRPSTRKTPVSSSNGLFVSDSEYSPQTQRSTSSLPSQSNSQQQQQQQQSSSPLSSQNQNNQYNQQNLQSTSTGRQLPPTGPKKYQTSPPQSNSSNYSPSSLSQPSHYRPTEPRFERRIRDYQTDEQ

SEQ ID NO: 23565 - protein, 71 aa, Candida albicans
IPTWMLPARGEDVVYFPPIIEVHQCIITLYILYNVLYVSTCPDQPRIVSLFIFALLSHAFAFRVVDFIFIQ

SEQ ID NO: 23566 - protein, 61 aa, Candida albicans
NKVMIISVWHVFIQFNYLNPFHSICQVKPPSIQLECFMILCTKKTVPKKYVESNATSKMMS

SEQ ID NO: 23567 - protein, 67 aa, Candida albicans
ECNWSYRKRGGLVCMLVFRCSNNNNKVVEEKKKMQMFCVIMYTELLYEDEIHNTKCESMREQSKDKK

SEQ ID NO: 23568 - protein, 88 aa, Candida albicans
FSFTGKTNALLHILLDLRQHARNVSYSVSFTKHTNIDICHRHCRYHLKSCVQPYLYIREFMYSTISLCAYLVSKKLANQRFPICQQIL

SEQ ID NO: 23569 - protein, 73 aa, Candida albicans
NSCVYKRLKIFKKKISLIYFQSNYTINTNINKVSKATNYPVYIIDFQICNGEDAAETTSNSPLQSTTVRTLQI

SEQ ID NO: 23570 - protein, 71 aa, Candida albicans
PFFGIGRSEIGYIQAVLQLYKVGINEYILVGLLLLKKKERKKNSISEGNLTSIYSFFFLECMSTLLRILCV

SEQ ID NO: 23571 - protein, 73 aa, Candida albicans
RSGLFVMKEGNICLGKMKFPKPEEGVCIFSQKTPFLGGGSPHYFKGKRPRGNKRGFKKMVVNKRGLKKSFGGV

SEQ ID NO: 23572 - protein, 61 aa, Candida albicans
  UNSURE (15): Identity of amino acid sequences at the above locations are unknown.
FKIPLLSNSSFFFLXNCYVSKPFFEKNIEKKSGVTTWYMHGLGIITISSSSSSSIFIIFFQ

SEQ ID NO: 23573 - protein, 86 aa, Candida albicans
  UNSURE (48): Identity of amino acid sequences at the above locations are unknown.
YSPFIFNINYIKEKAWKVTFIVVLLKKKEKKVVGIWKNFVLGGFVCLXFVGREILSDSGFSDEKYLTKKDRKIWVYKTKFMHTKLN

SEQ ID NO: 23574 - protein, 81 aa, Candida albicans
SVYRKVRDHNADINLFIDCSFYLRIVNLSQKTYWFCVLDRGRGKKTSCRVFASTKIPCNTPSIMMWVEVVICRLNITYLQN

SEQ ID NO: 23575 - protein, 79 aa, Candida albicans
GDITTTLYKSFLFRNFILLNWHYVVCLLGEVIGSKYKYSYLNIDRRLVALGLLYSIKFFLSSSLLDGVLIYRHIIILFC

SEQ ID NO: 23576 - protein, 67 aa, Candida albicans
SLLNISSTEASTIGSTNKSSSIIMNQIEKKKNKWKDNSRMRSKSNNFFFIVSKYTTTWQQNKITKWS

SEQ ID NO: 23577 - protein, 67 aa, Candida albicans
MQNQLKKQYSKRDEHDKDELKSKSKQNKTKRNETFRLKTQMILSDVIVHYTCCCYYCCCFIEFENYL

SEQ ID NO: 23578 - protein, 62 aa, Candida albicans
VLFFFTVEETPLPLKFLNEEVIVNNLRSFGFKFWKKQAIRDIRFMKSHAVTTTTISFLFAIV

SEQ ID NO: 23579 - protein, 75 aa, Candida albicans
ELLPKEPIYLVSEEVEVEVDSEPEEEEEVDSEEEVEAEVVLIPEALEMVTLNKLMVMPRMRKPIKEDLSENISII

SEQ ID NO: 23580 - protein, 80 aa, Candida albicans
LKLVLESQDQPNTSPRCSIYNYYCLNNDNRLKMLGKKFAIGCTSKIYPMYLVLQKSSNAICEFHYQLHNGIDIKSRHNGR

SEQ ID NO: 23581 - protein, 64 aa, Candida albicans
FVMNIKMYQLSINNKVIIPSHVMLHFKKKCFVIISDADAFSEFIKFKFVLNQLTLPPLFFFSFL

SEQ ID NO: 23582 - protein, 71 aa, Candida albicans
LRLTWKSELPPPPGEFADALTRLKSLRIKRFESAEYEDILRNLCLIKLKIAFKSSSPSSSSSLLSLSPPCS

SEQ ID NO: 23583 - protein, 62 aa, Candida albicans
IIYNWIKNHTDPVEEVKRTLLKQQTLIYIISFCIILTMKNKKKEERPFPRLNYISTPPTHHP

SEQ ID NO: 23584 - protein, 384 aa, Candida albicans
AMGTLIDDTNGLTNTPILASKNNVAKFQPSLNENEPTTTTTTTTISRESTIDKVNVPEENTSLIISQEDLYSTIDDDGDNDNESNSLTADTEDHNKLNLKSDSYTSYIEHELDLPQFERTIFQHHDIQINVPDSKHSLEATETDMEISEILQLPKSYFAYPTTTTSEFKHTDITTTTNLPDPEVVAAAATAAKSEEKEENTIPPPPPPQQQQQLIPSSGATEQKVNPVSQALKMNTSIKKLKLATSNNVDGATPLIINSPTANEIKLPTNNSWVLQDYEQLFGTKKFHKEIELAKSLRFADTTNSVCSDLRHEKLIYISTRIINPGKILSFYLKHPLLPPPPSSSTTTNTKRDLYIDLIMNNNGCNILLQLIKYIHENETLLDS

SEQ ID NO: 23585 - protein, 81 aa, Candida albicans
NNTTNKFKTIERKKETKSAYVINLTPPTDTTTKFISKREYQLCLTIYYHHPKSKSNSKPFYSTLFLFIFLLVKNYFHLLPI

SEQ ID NO: 23586 - protein, 97 aa, Candida albicans
DDEFLAAGSGHDTGDASKSTVVEIFVSPSMKVTVFFPAVKHLESAKSTEEPVPPTLNVMGNLTVPETLAYDTETLFTVHDKEENVVNSSPALKSQVA

SEQ ID NO: 23587 - protein, 176 aa, Candida albicans
NMFIIRRSRGILLLVSIVVFNLIVLSLFQFTPIDDYVIGNKYIDNIKQLLINYQPDSPSSLFSSWSLSNDAGFALSMNHDKEIAFHNQVASAADNHESTNELYNQLDSTTVKASQFNVIDIPNDIPLAYQPFDPRFTLGLILNYINEQENKDLELPSFHWSDFVDMSPLEDQFFQR

SEQ ID NO: 23588 - protein, 244 aa, Candida albicans
LYCFRPSEHYISKSQIKMNANQLRIPKTLHFADEISHLNSNFISVNSYNQNPTSTSTSTSTLANPRSINKFINSTPKLPLAVNQNSNSLIYDIIDLYLLPDTAPEELDSKTLSANDKHNVQPALFASLHKGYHYFFGNDYLPSTCNSVNDENTRVVLDMNMNMNDANTAIYHDENIETQSINMWFKNKSAGVFHKLKSFGHRSSSTTTNRTNFKAGETVDEKLKSLFSETTIEENNLKEIVEQR

SEQ ID NO: 23589 - protein, 80 aa, Candida albicans
INDLLANFREIQSLIYVKRENINRGRYLPLFFLIQKKKDYYLVFDFFIFVFTLYPQLQSNTKLPPLPPLLTILFFSFSLI

SEQ ID NO: 23590 - protein, 236 aa, Candida albicans
TQGSSVYERVKHLDEMGFTQVIKQLIKYYTDQANDNLFNKSSPDESRMENVSVLSTVLFGKGHDILEKLDTALRQITALLNTKTNNNNKRGRDIGVSGVDGHPNNNNDNNNDNSGYMNRELRLQIDGDNVSIIKKYSDEDIERRANQRHQERERRDNDRYQISQRREAIDSEDNDDDDDDDDEEMEVDQDQQQAGGGAGGDDDDGDFDYAVEANYEDRDDSESEASDEIPDEYWIM

SEQ ID NO: 23591 - protein, 101 aa, Candida albicans
  UNSURE (17): Identity of amino acid sequences at the above locations are unknown.
TSFNLSSNPNRVHNLSXTISQSCKAIMSDFLGSCLKVPTFSLFTNTRKHFLFTSPGSEANGNTVKEVPATMATFTSSQSSSHKSKNLTGKPSPKNTISGLT

SEQ ID NO: 23592 - protein, 114 aa, Candida albicans
KEPLSFFIEHIAELDEEDEEIESEVTNDSDDSDSDSDEDVNVNVNEINEHLKIMGDLPFKTRKNHHDYIKTPYPKLISFKDVFNLNKINSPQEDNEEEEEEEEDLKNQFHRFKL

SEQ ID NO: 23593 - protein, 86 aa, Candida albicans
KNNSSKKEQSGGRGREGRETLNERKKGNLHLLCNYSIHIVIPGGLMTYYLYKFSIVNEIQTKRGKMCVYVWVIHPSSPRIAPHFKV

SEQ ID NO: 23594 - protein, 97 aa, Candida albicans
KMKCYHINASTPLYDEEVEAEPEGTRLYTDATEEIRISEKKRPREESDEIKPTPIIDNASSTTTITTITTTTAASNSNDNFNGTKKIALTTTSDNQL

SEQ ID NO: 23595 - protein, 149 aa, Candida albicans
ILFNIKTNPYGFKSMSHHKFLDYFNPEHIAQKGLFASNDLILLLRIQILKYCQNDKDKLRTYFKKHPKTMKFVMTEKSTILPLKFKGFRSIIDDISPLGNLNWKQNRIARASRVLKSLLLDTKYQMFITADANQSTPMLTKLPKHDFYE

SEQ ID NO: 23596 - protein, 64 aa, Candida albicans
WNDCLIDAVGLMLVIEVVLSDHTLSLYNCNNVNTITTDVITMDEVNARLAAACALFTKLNIVEA

SEQ ID NO: 23597 - protein, 461 aa, Candida albicans
PPLRYLPGLCREDNDINVSNFENSLTTEIDVQENNNGGVIKNHHDNLRKLPKKIQTILNNNPSLTLFKQLNFYQYQLSCYHNIIPQGELINNHYNNLLNLNLLKNFENLQTINEQATQEHELIERKSKNILNHRMSLCSLSTPTSNNDHMGRQLQSSSRRNSSIFERPNRTEEDDDYDGYEDDDADQVSLSLNELINQDEDILIHSLKHQQQRKLYHQNNTNNNNVIPTFIDKLSIWKNKLLASATGNTTNSKKTHNANKAYENPFFLANEEEDEFYEVPLDPYTKLLSLYHHHHQNQSQGQGHGLLLGQKGSDSNYYYSTYDSINEEPQPQQSYLKRNDYQLFYEFNYDQTLSYVYFTLNIISLFLSGIQLGIFMSILQKPDLSGGNDIDYQFLIRDNIGLIVILTLGIITSLIFGLISVNLLIQRFNQPPLFHVLIVWGGLLINLICCVWSGVLLIGCL

SEQ ID NO: 23598 - protein, 64 aa, Candida albicans
FINHVGSVALNKLIAMCVCVVFCFFSKQFLLLLCEPPPLPPPEKDKKIFQSLLLLLLIFFCFSV

SEQ ID NO: 23599 - protein, 240 aa, Candida albicans
  UNSURE (238): Identity of amino acid sequences at the above locations are unknown.
LLPPPKKNEMASHSNSNSNSLFQNDKNNNSNRDIAIPTPSNSSSFRNTNTNPTPSIRLPSPSINSYNNNNNNNSAIPTTTTSRSITGMSNASINDSGDSNPQSYDEQISQLNNLNNKKSFDLKTISKHLINQEDSLKTQGGDITRRLYHQMENITGNNNHNNNNNNTDTTGNDLDDNVSIGGNSTFRDGPPPRLRTRSASFSSYLEETRRSSMASDINIPGWNRTKIFINRALQKNRXPP

SEQ ID NO: 23600 - protein, 342 aa, Candida albicans
GCFSNNYYLPGCCVKKKSILIDHGKNNQLNLSETFNSLKSSPSSTSSLSSISTSSSSSCHKRSKAVDLNRNTSNSQNSSISTAPTTATAANTTPRKTSITIPSKLPSLWIPLRNGNIDYSRYYNTNQEEDNQEQQLQDGEPLSAPTTNNGTTKTATANANIIQDSFETIPCFSSTTNTTITSSRSNPTNSTPTSNDPSFPKQMINWNQFLQEEKDMNDNLSTINDDDKTFYMEQLNLNVGQTPNNNNNNNHGVSETENDLLPGTSKSLIAKYHYQLNYGDENENETNDVREYEYGGGESRKRKSSTTSDDRRPRRGGGGGGSRTSQVFRNTLNKFTFKPKIK

SEQ ID NO: 23601 - protein, 87 aa, Candida albicans
PEIWLNCLNQKFFKYPFLIKSNQISLDILFFLHCGRFKKIKYITTTTTITTTIIRYKHTSMLLFIKAKQSKNETQKCQQIKFTVNFL

SEQ ID NO: 23602 - protein, 355 aa, Candida albicans
KLRSMFLPHLTPLSLQHEKSRKFSLEEEEEGEEEEVEEELTTYDEIEHNKKLETNFPFRQQYDIDNKNSLLSRVKHMHVSSLSGDNFLRRQLNYEEEYGNNNNTEREEMVTQYNNNNKSNVDSSKNILLNQNSFEDISQCNQAKSDSTDSLCLEVANHNKNNNHFISGTSTPPDTMYNYNGLPMVYSSLENNNKVPRKQFNLHLQQVPPQLQVQLPQSHNIQRSLLANSSATNLNAYLRGNRRYSSSGNSNPINDLLTSPKFIKSNKFNSPIPSSTPTTTAQTSPITNGNPVIDQKNRLVDQFYNSGRITSPGSRVDLSNMHKEALLISPTQQQSFSKVSTPKSERKFNWKERFT

SEQ ID NO: 23603 - protein, 81 aa, Candida albicans
KNHFITNFTVNNLFILLLFICIIFLFDLIDRHLEKRSIHPSTSFQIILNYIVVANQLKVHFDQVFILFILVSMCIDLFYSF

SEQ ID NO: 23604 - protein, 101 aa, Candida albicans
YEYFTKTFSGVEFEKKNPTVNLRKRELDVKYLEPKFLFLDKVLNETKRKLSVVMIFDVTYIHKAFGECFFGSFVSSKLQHNVNNNNNTGYQTSLPPLIMDN

SEQ ID NO: 23605 - protein, 67 aa, Candida albicans
FQDGEKRNRFRDFRELAWDTQRNENNLGIIQNLTHKIRPNTIGLICELAAKLKMKNLNWLIKKFLYL

SEQ ID NO: 23606 - protein, 85 aa, Candida albicans
GKNKLTIRNELYDFTTQTFILNYITSIVQNIDLRYSAFQYRPLFCFKDSWNIEKSHTHYPIPLQPLFYEIAIATFSFYYFWLTYI

SEQ ID NO: 23607 - protein, 62 aa, Candida albicans
IHLSSRLMKISRQITLSLLRKCLNLLLGKENTIKNQETDARHAKRDASNVMNRDLYVATVPN

SEQ ID NO: 23608 - protein, 67 aa, Candida albicans
LLVFRSGCCHHCSPTTIRIQESNQRKSQTRCLRSLSADNSMGAAQPLVLINKQIMPSMSKPQPETLQ

SEQ ID NO: 23609 - protein, 69 aa, Candida albicans
IYIFVLVFLRLRSSICYFYSFGKSILISFFFSFIFHTYTLVVIKVYSVTPLYRRLARSILIHLFYLSIC

SEQ ID NO: 23610 - protein, 263 aa, Candida albicans
MSDNRPTYDTSSSDEEPSNHFHIQLPQRQLNLQEIRKQNHKKHEKPTIAKQTASNLAKAKKITTGSNHKFGNSINNNNNNANKHLGSSSAGTNRRSLISPTSSTHVSSDDDDDDDDNAAFYGDKLNDNKKLNVFADTKNNLSHFQFNADGIKPKSLHGQGDDSSDDDGNNLDEVEDETHSDFAVLNQNHPPQQYYETDSSDEDEEDDDEVPPTVHKTYSNASSGSSSPPSRKKSMSENTDTRSPIPLNGKKIEKLQSFSRKLW

SEQ ID NO: 23611 - protein, 74 aa, Candida albicans
QMDERSLKKTRTNIYIYISKGRLNVIIDVYFIYRSIMLTKRKKKRKKKRKNDKREFCVTHTLLILKVKLVTKIK

SEQ ID NO: 23612 - protein, 85 aa, Candida albicans
TALLFPIFFFHRSSNEFYKPSPGCINTQQSTDNKRPYFPITQILLKAKLTKHTKQCLHLHQLHPILKLLKLVVKSKMLNHIKRVR

SEQ ID NO: 23613 - protein, 70 aa, Candida albicans
LPWQHSIHLEQGRCSFLNEFRTPSGIILKFPFTLSLVYLEGYTDSLSLNFTYELLHSGKSIWAILQSEKF

SEQ ID NO: 23614 - protein, 79 aa, Candida albicans
TAELSILYFVTYTTYSQSTPTVSAVVQQLVNWTVDVVVTYEPSKLNTRVRFPYRSNFIFFLLINYFCDIYLSFFFFLNV

SEQ ID NO: 23615 - protein, 84 aa, Candida albicans
VPIKNYMENFKSPNQLKASWLKNKEHIFLKCTQGALTFFKMHFKNTKKNLLFCVVTLPKNSESWVCVPFLQIPSLPPKRTPNSS

SEQ ID NO: 23616 - protein, 70 aa, Candida albicans
LKLGDTSQAITVFENSLDLTYVSRDIKINRWKLKLNRAVCKIVFRQLRYLGKFHHETPRNIPSLYFSMIF

SEQ ID NO: 23617 - protein, 96 aa, Candida albicans
LIRTFEIFHIIFYRNLLASLSTIQDMVPARQNDNSLLREHKVYQCTEKQLPLSFYGANVFIIFVIILLAGSTYKLITISRRRRRTFNQEFEKTNPV

SEQ ID NO: 23618 - protein, 79 aa, Candida albicans
KKTNQQYKNINNRLKNTKKERIIELLLYKISLLKRLTKLTLSGNNMDNRGAIHYYCSGSYWSTIMLKRNKSILQKYKLK

SEQ ID NO: 23619 - protein, 104 aa, Candida albicans
LYILLTVLGIWQIGNFTGLWLLQPNVFFAFLHDLLFVTRYVKQFELPFGAKSFFATFSLLLLLYNQLSKSISFIKEPGILSFSNGNLSEQHYVIKKKQINNIKI

SEQ ID NO: 23620 - protein, 68 aa, Candida albicans
FFFYYIGVLRANGGGLWGKNFTINTTILIVRLMVVLFLSTSGKAKAKIIEQKKNKVVLINHNWAIFRI

SEQ ID NO: 23621 - protein, 90 aa, Candida albicans
VFLLCKNGSAEKGDIQISWKLLRGITKGKFPNVKGKTTKYLVFIPLVVVEFVFLVLRYSPFLFRILPFISNLLKTPTGVAPAISVLKLAG

SEQ ID NO: 23622 - protein, 73 aa, Candida albicans
TKLLKRWLERTIKGKNPFCFKNNKANSFIVDLFRKITSNAVNEQLQFLLTKLYNYSKIEYLRNIRFKLFYLLK

SEQ ID NO: 23623 - protein, 73 aa, Candida albicans
SCSLTALLVIFLNKSTIKEFALLFLKQKGFFPFIVLSSHLFNNLVQFITKKPSQLLSTSSFDKQLSKYLKNYL

SEQ ID NO: 23624 - protein, 99 aa, Candida albicans
IMNFHSTKPLSYDSSDNEIYNPFLVSTNEEGRVSPTIDKQQQPVLKRAKSIVSSNSLSAFFTDLKSKQQQQQQQRDRKRNKDRRSLHHEGRASALAIAA

SEQ ID NO: 23625 - protein, 262 aa, Candida albicans
KKYTEFQLQLQLQHHHQHLAPSTSVVFHSIYLFIVKKNSLSCTMVELQVNTNPDLKSKLIEEQYLQESNNLPIYLTKIEVVGGESFSNQFFQNLLSPILQNGDLTFIQLVNKIKSLQLKLIETGIFDKVAIQILPDNFYSLSSNKIKSYNNEPSLLTKVLIDLLAINLSNNQGFFNFNNEEYLNLKLNHINHNFNGNGELISIGVDYNPYKPLDHLIANGKFISYLKNPKFKFLIDLQLNQENNETWRLHPRRLAGSALSEE

SEQ ID NO: 23626 - protein, 609 aa, Candida albicans
  UNSURE (595): Identity of amino acid sequences at the above locations are unknown.
KKQQLTMANRNDDKKLSQNEGQNYYHQQPTSHTINQSNVAPPPLPPPPGANFLVPGINQLPGQQLPAHFSLPHQQQTQTPISQPQPIIHPFPHQHQLLQQQQQQQQPHQQQSQFQLLTQPHQQQQQYPPPEPLSSTSSYHNNTNSNNIQYVRLFRNHLNPYYAVNLKFLKDLNTMTKFWTNNEIENLRRLVKFNFKSEGSTQMVNFEPITPEQYDNVSPIISCIYWKEKSRYISTSVDIITLLEYMVKQTFDVDEKNRIRRNLQSLKPTTISRINKNDRRFFDLIMSMENPRPRNIEKDLKVFDWSDLGRAVQKVMSKYYVVPSLAPTTSSSFSSSSSFQHPNPQQMQSMPGIVGNSSQQQQQQQPLSVPTPTPLPSGVPAVPVYGIYTGRSSFPINQTPIHYLTSPIGNNNNNNNNNNNTGGSFPKSQVASPSVHQQHTFNQRPGTFFPSHNYYQFFDQPKSQPHLQPLTSGGGGSGSNTNVLASPLHTFESSNRQTLPNESSDKYQENQTGAISGSNDDSRKTKSDFKENNNTTTKNEEISGTTKETDNNDGSNEDNNKLYSNQYHSRSSSFPQSIKSLESISSSGSGSGSRXKVHNEKSTKIITPH

SEQ ID NO: 23627 - protein, 62 aa, Candida albicans
TQFRFVFRQGFFSFSFLPLCIALHFFVTISMNFLVLTTQKYYEVKTNISYFLVTAYINPTCL

SEQ ID NO: 23628 - protein, 61 aa, Candida albicans
EGKREKALSKYKTKLCLECNDRNDVSYQTLYFVSVDIEVENIFIRIDFGDHEFNCEFVEKQ

SEQ ID NO: 23629 - protein, 62 aa, Candida albicans
KFINKKFSIHYLDRNPNQLLVGTICCYHFHDAIASQSYIILLSLNCFREDVYTLLSFACSEN

SEQ ID NO: 23630 - protein, 71 aa, Candida albicans
SNFFLFYFCVIVEQKKYNLQSVEQKFNDNLPGVSFRMNTIDIFTRKSFVFEETGYERDFDNQIVVKSIIEL

SEQ ID NO: 23631 - protein, 65 aa, Candida albicans
RMSFICCDVKNRMSVFVALILKFKNYKQRGKDHHHTTDRVKIVTMHALRLLRFERSKLFPNKNNL

SEQ ID NO: 23632 - protein, 64 aa, Candida albicans
  UNSURE (22),(29): Identity of amino acid sequences at the above locations are unknown.
YFYIFSPFRFIFRNSLGFMLHXSTKSNDXLDINNTGLCLANNLKSYKECVVKLMELNLLIIPNG

SEQ ID NO: 23633 - protein, 60 aa, Candida albicans
NCWSRILRVAFSFITGSLFRFLFYKPFLNKVVIMVNEYNASYNLLYNKYRMEETETETET

SEQ ID NO: 23634 - protein, 64 aa, Candida albicans
  UNSURE (8),(15),(42),(50),(51),(55): Identity of amino acid sequences at the above locations are unknown.
PSVVYIQXIVRFGTXMQHKAQTVPENKTERRKDIKVSGTVNXFTSNTFQXXDTSXFYFVPRRYN

SEQ ID NO: 23635 - protein, 61 aa, Candida albicans
TCSNTVNTSAYQSYSREHLIIMLYAITKHRTYNSNVRLTKKKKRKALTVYNYWNMLKFIYD

SEQ ID NO: 23636 - protein, 105 aa, Candida albicans
RHTPQIFNTTLYSISHIHYVLNIFTILDNAYPLLDQCKLFNTREYRELLSCWNIFQDSKYFSENNITNSRSKIRGNMNTQGTYNNGKLLIVQPSAAKPITTSVFT

SEQ ID NO: 23637 - protein, 62 aa, Candida albicans
AISIPTLFLLNQTIKFVLSTNKDTDTGFRSDKSVFVERENLSPPAYIINLSYSARFNFGDDA

SEQ ID NO: 23638 - protein, 64 aa, Candida albicans
KSVCTVSKKCEGIIFTNSKQIYISKNDYNKQSGNCIVYHPAVGSVILLKSSIQLYIASHIFTMY

SEQ ID NO: 23639 - protein, 190 aa, Candida albicans
  UNSURE (141): Identity of amino acid sequences at the above locations are unknown.
APIQLQQTPLSIMYANQRLSMFQSHIDHKQKRTIPSFPFLSIEEQENYELSKSLQQATPLNIANMTILPSPSPLASTSSLPLMGSCVIGSNGSTKAVHQQDQQQEQQRPTPPLLPHLISNLPITPITSSSSTPELDVVDTXLVLNDVLKEFNNGKILCLSKDDDDGEDDEQIDFDNDSLLYDTINEISEQ

SEQ ID NO: 23640 - protein, 67 aa, Candida albicans
GRYRLVDKVPATYIIGRDYHASKTTDSKDQDQVVDRQQRREKKKLANCYNYIIAAIFVTLFFFTTND

SEQ ID NO: 23641 - protein, 272 aa, Candida albicans
TNLYFLYHHYLHLYYLPHQIKPRPVMTVSDPLEKLQQSFRSIQSTNFDDAQMFTNSIVNAPAITTLLKDPTHDESLLYKIVKPKTNKGPSKLVSAIVESASMDSKPERVDGKILYTLEGIISDKPEDEDSEEEDGRNPVVKFPKLGPRNAYSRPFINLPNSEDFKETFYQISQVLSKYPNLIDDYPTLINKLNTYEDNYRKLQRDIESLEEEIKELKAFLEDNYNVSYSPKVKPSASFDSDGSDAQIDIDEAIRREEEEIEQLELQFNQRGY

SEQ ID NO: 23642 - protein, 93 aa, Candida albicans
HYFYIWDLKKGSNLNINCKMKNVVYTDSININSSVVVVVSSVNPFCIQDLRSYGTHANEKGRRTESKRTLIRITFFFSPPPTTTFTHFNRRIN

SEQ ID NO: 23643 - protein, 106 aa, Candida albicans
QAMSNMESSHVNNVESPPEYVSQPPPKYVPRQSSSSSSSISDQESDIHNPPQRASENQLSTCCSDCWCNCFDSCSGTNCTASDKNICGSILVVLCCGSTIGYATNA

SEQ ID NO: 23644 - protein, 122 aa, Candida albicans
CMLYSILLKHYNSRSFSFDLCILKKLVICIRKRKITRHVMNGWMVHSLALYAILTSSPLSATTTDPTTTNKTAMTTRNSNENVGKTSTTQSKKEKKNNLKNIFCKTNIHIIHYSIAEYLVFI

SEQ ID NO: 23645 - protein, 69 aa, Candida albicans
NPYFETARHILLNVLINLDQFIIINLFQIEFYKLSVVPKNADTLTFSQPPSPLRVLFKLGQEYHKFSWS

SEQ ID NO: 23646 - protein, 93 aa, Candida albicans
FSIKSTKNVEFSSMSSKSSEIIISSFTVLNWNLFESKAPIIAKALAHAVETVVSLFLNFAAVSKIVRTKLVIAGVKPGSLKRSFWQLIWYFSK

SEQ ID NO: 23647 - protein, 74 aa, Candida albicans
IFFTSFLFLSLELSFIFQNTALFQLIQNGNYRKKTCKITINICMYYYTVNATLFVIFFFGSPPIWDEQFVVAIP

SEQ ID NO: 23648 - protein, 88 aa, Candida albicans
ALIVAGLGNSTNNVRLSSITGNKMSNETCWTTHKHVVSQHCLRVFGIDNQIFFNREIKNRRELGLKLGSPMVGLSSLVVLLISRHLCL

SEQ ID NO: 23649 - protein, 76 aa, Candida albicans
YFLHANSKGGWMLLALDIYKLFYWPGTEIDIVSGLAACHDNLTMGFFPGPSNQQFKKTKANKEEEEEDEKIIEQTK

SEQ ID NO: 23650 - protein, 400 aa, Candida albicans
LYFTIMATIDVEQAILDGNTHKSIPLSVYESSLAPTYQSSLSSLSSSIINSFSLKSPIEFDPLIHLTYYANGSRAQKLYDQTRRLTLEQLGLNHKQQQSQQISDIGVSDPFQLFTDEAITIMRQEVLQRDTFMKYARYSYNSTSGMDCVVRGFVKDGDEINCPFTYQAWTHCKTMELVSKMAGVELEIVMDYEIAHTNISMKLNDMVEEERIKHQRQLIDQESATSTTTNGGDDIPAVVGWHYDSYPFVCVLMLSDTTNMIGGETSLRMGSGHNGKVAIVPSPTKGSANVLQGRLIEHIAPSPVGMSERITMVTSYRAKSPMMKDTSVLSTVKPEVNYGSRYNQFYGEWIDYRIKLMQKKLDLINLNTKCDANSGKFNKQKTIEALKEVEEYLLKTYSEM

SEQ ID NO: 23651 - protein, 65 aa, Candida albicans
LIDSIKRTKLQFFNYQIPFFFLFLLVDCNCAKKSVCVNSERKENFFTSSVEKSRNIHVHVLPLGL

SEQ ID NO: 23652 - protein, 78 aa, Candida albicans
LFFFSFACFFFFSSTTRIREGCEITKANQKYTTPGPYMSISVSYVILRTDTGLVLSNLLHLLTHLFILNIIFYFIYCT

SEQ ID NO: 23653 - protein, 139 aa, Candida albicans
FFYTTSKKIFFPLTIHTYTLFRTITVYQQEKKKKRNLVIEKLKFGSFNTINQLESQHVNSKRRQKEDPPIPLPRYVNMNYKLEQNMAFQGMHDKSRVHEKAQIITVVKKNFTTNNNKKISKRFSNHYLQETYNIMESLI

SEQ ID NO: 23654 - protein, 62 aa, Candida albicans
CKYYTYVFLNFIHSHTNSFLTNNFHELKEKEKEGKKKSSFYIGLYSNIKFQPINTGLNLHII

SEQ ID NO: 23655 - protein, 101 aa, Candida albicans
FEKIFFLNFHFFFFFHAMEDFYIYNLLDKVINSLELLYFDSKTSESVKADEPPKTPQPPPNQHDTEYYKSDLYRYNLKRKLNDLPPVTEQQFDKLLERRIH

SEQ ID NO: 23656 - protein, 69 aa, Candida albicans
  UNSURE (36): Identity of amino acid sequences at the above locations are unknown.
FVFQGILLAFRTTFFFGWEPMNFLIDKLTVVPDRIXVGGALPDVFGWWELWHRQIAAPIINNVICGFEK

SEQ ID NO: 23657 - protein, 81 aa, Candida albicans
IVLNFPKIFWTSSDVVPAKTNQGGATGLIYGSLTANKNDLYVLSTPNSKIPQDLANTNKCLTKLNHSKTTPCCNHHNKSTI

SEQ ID NO: 23658 - protein, 66 aa, Candida albicans
IFLLETTPVKQCITNFNEFINRVTNLSNFTIYLELSSNFNHFEIEQLLEPKLQFSQINSSLIEQHN

SEQ ID NO: 23659 - protein, 76 aa, Candida albicans
PRMSNFKRAPEQSESHTNKSRFSHNFLANRGHTPRVSNTFPAAAPQPYGCSPFFFFFFFGVLAPPLVRMGVRMSWV

SEQ ID NO: 23660 - protein, 66 aa, Candida albicans
ILQSTRPSLYFRYFKIFFCPFFSFPWFRGKKKIYNNNKTSFPSSDAYQLTFIILSKLNHHFNFQFN

SEQ ID NO: 23661 - protein, 219 aa, Candida albicans
LMSYNSNTHYTPRYGKNHSKKIYDSGTGGREGVTLQGNQSSSTYIGSAGKDRETGTSSLSYSSSRRDTYGGSGYRSRYESYTSKNGSSSSNSYYRTGPKGGSTYYGSRSHSINGQSTTGGVSGNGSSNIPNRRRPGFDRYDSYSKYLDGNDKFISRAGNYSSSSRKSSHPTSNYDAKEDKRKSSYVSANNTSESLNNPMNSSDQRNFKFSPQRTSTTRK

SEQ ID NO: 23662 - protein, 92 aa, Candida albicans
FDNGATTELCNLELSSPFEPKSSLLLGDTASSQTDAVNSSLSIVEVRFCILLNKKIWLANLNPKSLFISRVHSKKKIDNHSVTHFFALVFSE

SEQ ID NO: 23663 - protein, 63 aa, Candida albicans
IRNILIELLSRHTKKLCKDSQLVLRNVKCENDFHRRKKNVFLPHKISSVVYIHFPNYIPYSNN

SEQ ID NO: 23664 - protein, 60 aa, Candida albicans
TQSYFKRKHNIKTNKQRLSQEIQIKQQINDPQISIVEQFTLISHNKSIAPNIAAINPASP

SEQ ID NO: 23665 - protein, 122 aa, Candida albicans
YYSIKDQQSNNFICRMRVFQIVYILIISNLIYATSGGGTSSHHHKNDNNIADNTNNNNNNNNNNNNNNITNATTTRTVTTSTKTKTHTGGGVAAMGGILGQNGWFYGDAGLMAAIFGAMLLL

SEQ ID NO: 23666 - protein, 60 aa, Candida albicans
ELNPIRKSIEKRNVYSHYLSAETKLKKRVVHDPIYMDILFFFLSVVVVVVDEDRRKISYI

SEQ ID NO: 23667 - protein, 241 aa, Candida albicans
IMALCSPTFPSTSAVVAGAATKRGCSTFNSLYTTPNKRICLNNKISAFGGIGFKGFYNSSLSSEEEDSESDSDNGAQSPFEAIQVRRKLIPTRKSSVVLAVTGSETEIENLDCSTVHYTDSQDDGNCDNNNSIPIADRNARTRCFEYLIGAIDEAWARYCDATTSFEDDVFGSNKSGTSTTKRAYNGKLNDNNDDNEDYDDDDDDDDDDEDDSADETFDNNTDITDSSHRQSRSKFNLPER

SEQ ID NO: 23668 - protein, 64 aa, Candida albicans
KKFNISSNLLSFSGFYSIVYVSVVLFVKEVVEFKLGGFEKIYKRKLEAEFNFQVEREREREKDQ

SEQ ID NO: 23669 - protein, 66 aa, Candida albicans
SCSYARNSKEQIKYYYLISYWRGNGTFRILFNYSPFSFLYQLILDLIKQLFNLIKQKILQIEVDIL

SEQ ID NO: 23670 - protein, 259 aa, Candida albicans
LHCGSINMTNIIIDHQSTFTAYILALSIYFKYLHLRNLKIMIIENEISQSLDTKPWCGISTLNNFKLSNQDFINYLIQFTITLGSISIRPVSPNPDTPIKEIMNTTIDSRNYVGLLYHPIDLMNKIRFAMFRSGRVLFVSPNVNFNQPGPLHQNLSGIRVVTTTAMRNSHNINSFIYHSNMIGTRCRNGNLPSQILWLPKFSSGNHINCTTTNNLQIMLDLSIETYAYIDLSYALKQCDMILDTIDKLMGSSIPLSNRL

SEQ ID NO: 23671 - protein, 141 aa, Candida albicans
GIDLKNCTIVPKKSPNNPNIPKLSKINPINAYFNNINSIPRIKQIVPLNFVGRLKNAIVRCGPIINVIPIINNTLPSANNAESKNVIIPNTKKKIPPAVKLTPNSNIKKEKERIIVSKANFSKKQIQLFWQTNLKHTLSFR

SEQ ID NO: 23672 - protein, 63 aa, Candida albicans
LPIYTRPGVNTTTPQLRRSRKKERKKKKKKFKVNKYHNRSLNQIHTTIKSIGKLLIIKHDLVI

SEQ ID NO: 23673 - protein, 74 aa, Candida albicans
LQQKQNLIHEQTYSVTRGSPKPQGFSQLYQISEGDAIDSELHMSAHPPFIEKIIFNNLLFPRKMTCQNPIPKNI

SEQ ID NO: 23674 - protein, 76 aa, Candida albicans
YDPFLQEKCTPWKFGNKIIIFFHEPGREVISSNGVCQNQDKGYSLANNNKFNANGGGGNQIYGTRIKVTTHKSKQK

SEQ ID NO: 23675 - protein, 351 aa, Candida albicans
NFCHVRFIISEVYIMEKLSIDNNNNNRRYQSRRFDGITIIRIVVLVFIVTVSTYFVNSYTCNQPHHNHSTRPSHYLPINGTHGLMNNDDSLHNKGAIGHYNTTVSLERRADENNSTTNGLFPLTSSSTFIFTPSSSSSSTFQQSRSSPQTTSTSSFVATTSSFQQETSQTSIPDTTTDFSFSSFSEAPTTSTTSSTSEFSSTPQETSNTVTSTSSTSTSSSSSPTSSPATTSASQHVTTFSSVDNGKTIVVTRTSVISSLPTASNSNNNKNNDNGGGLSHTNRIVVGVIVGVGGSILIGLLAVLFYLRKRNNRDYEGGWTFWRKNEKLGSDEFFNGELGVRDRNINQGSNF

SEQ ID NO: 23676 - protein, 64 aa, Candida albicans
SFLTNPERTKSLNIMNAGFTLDTGGIEEGPGVVAGVGPGVGIGVPPFDAEEDDDESSCSLMFCS

SEQ ID NO: 23677 - protein, 64 aa, Candida albicans
CCICACSFSSCRFNFRKSCEPDRLWWFDDDVAEETIPYNDDVVFLRLEKFDDEEPWVVEDVEFR

SEQ ID NO: 23678 - protein, 98 aa, Candida albicans
DQMTLKRTISRCYIVNLTFNTTPTNTTFKKIHSWCCCYETHIKINKLTLNPNPIPQLSTPLFCRLSPLPVDYTCIQVHWVFLYSLETNIIQKLKFKKR

SEQ ID NO: 23679 - protein, 88 aa, Candida albicans
SSPTSISISMRETTPLKKSYKKYKSTTREDDSEVLGYYDHEQQYEEYEDSFSMSKTTKYTLFTIIGLITLLALYFFTVFLPDRSFVFT

SEQ ID NO: 23680 - protein, 322 aa, Candida albicans
  UNSURE (160): Identity of amino acid sequences at the above locations are unknown.
NTIIQDYFTRIPTLAEKIMFASYLLLVLWIIRLVPTTHAHTGNDAEYLLNTVLKRDATSLSRNAYLDLEATSGATNYCSDCDNDEVIVTVDGTSTIWTILLDSTISTLVTTTSTEKTTLTSCGQSCTKSKDASSVSSSSASSSTSRSLIFRTSTKTVTDXTTLPTVTEINTFTTTDSHIVLVYTDINSESTITGDYTFIKNKNTRTVIITDYVTSTVGGETQIVTQTTTSVVYELVVTCPDHDFATTLTGSETFVPPTTAPKPVETPSPEPSTTILSIESGSSVPSATTSVLDTSITLETSSSSIDFLLRLHTRRSKDTRPS

SEQ ID NO: 23681 - protein, 79 aa, Candida albicans
SSATFKIASKKFGVPPVVIPFKRGNVTVGGLEKAVNGKARPWFINWCKNRKFDLSLKQKSDLIASTTIRINLLNCGFPY

SEQ ID NO: 23682 - protein, 64 aa, Candida albicans
FNKLSVSKKRNVLSDRSLASDGDLGFLSLSLLSLFWDIEVIAATRSTPLSSHIESEVICANTSK

SEQ ID NO: 23683 - protein, 84 aa, Candida albicans
  UNSURE (4),(67): Identity of amino acid sequences at the above locations are unknown.
WKEXQGEPRRYEIDPTEFNVQWPVAQIGSVKKKSSKGLEILFNNRQLTNGVYLTWRPQIIPSFWERXETLLGEIFGPGVENLFE

SEQ ID NO: 23684 - protein, 62 aa, Candida albicans
IYLKIYLSPLYKKHMILLFHYLPIHLYYPPDQTIINHFNNPKSGSSDGTNYFSNLHHRIEYW

SEQ ID NO: 23685 - protein, 107 aa, Candida albicans
LNLLLELELELELVIVYNSKVCIIYITYMYMDFTKKELIYEYNGINEYCLSFLCRESPGLGQDGTTAHRRASLFTNKYALAHGPKISTKILTTDSFREQQVQQHFLV

SEQ ID NO: 23686 - protein, 306 aa, Candida albicans
QQIHFVNNKYNNISWCKQERHLISNNQSIVSVCFVIGGSNLKKMPESSQTASSSTTAGASATTGTTGIPLTNFNYYFLLKTENIEPLIDIVNRINKEINDNQNLIHSLCLQIDNHGKFPDTIASSTNTNDNSSTSIDDPLRYLLEEKYNITRSPNLSLTNTTTNLEDYKQSLINDITQLRQLQQSKNLKNRQFLSIIEDYEQELNTFILPNLRNLIINNLDSNKHQKSKKSKTSKDILLIRKQFFMIEKLIYEKYEKYIIRLWKLIKFIKLLNKFMIKLKQQQLKQKQLEMIQEVKELKLQLQEIK

SEQ ID NO: 23687 - protein, 74 aa, Candida albicans
VLSFNNQSKVTTIWPNPEHHLPKASTGTKSKTSINAAPLLDRIKPYDQNNELSRIGNSGYKSIIHSTKVVLTNP

SEQ ID NO: 23688 - protein, 541 aa, Candida albicans
NTNYHFLEYFFQAFSMDSNNDSKTKRQKTGNLYLNYTISSNDEKIDIITDISKLSPKSFFNDYIAIRKPVKFVTLSDQQVIQLNKFELENLVDTLNYNDEELQVEKKYPAGFGSGQTRIQMKLSDLVNEIKNGNDEYYLTTQYDFDDPDRASDEEDEDEGEEEENGNEGGVPFDQFSDTSSIDMNNLHDDFEDIEDDFDESANDEVNNQDEMTAAEAEFRIKELYQPPLTNLVNHPEILPYSPSFFNLVPQQINLWMGSSSTNTNIKETHNNFTIDESKPDLGLGKQLPGESPRGTSTGLHHDHADNLYILVLGKKRFTILSPNDAMKLYTVGNIYKIFNSGIIDYEIDENAPGWKHVRDDGAIIEEIIYWQLDKSRLTNNGHDKEAEQKLLNELQVHIKQHQAQQKALKTTSGIRRDPPSFSKIPPALLHLDELKDESIRKKIESFANKFFPGVLQLNKLEVWLNPGEMLYLPAGWFHEVSSFGSDNKDNIGGAHIAINYWFIPPNTTNFDDCYEDTYWKEDWEKTKQAMQLVKDGVVNL

SEQ ID NO: 23689 - protein, 64 aa, Candida albicans
KKKRKCLKLIKMISKEILMIIKKYFQKNILLNIRNEDVDIDIDRYTYLLRMQEEINIQVFLSLS

SEQ ID NO: 23690 - protein, 109 aa, Candida albicans
KNSVASFISLARRFCNGLILRIHFSTAKTYRSKLIQVYFNLQKNVVVMAERNLFMQVKSLLKNEKVSISKEYNSNYYPHGHKIQLKYLISFICDTLLKSKKFRSNTKSK

SEQ ID NO: 23691 - protein, 62 aa, Candida albicans
KCSFLLEEGSNNNRKPHNYMVLRDQIPFYKDFSSFSHFDFVLLLNFFDFKSVSQMKEIRYFN

SEQ ID NO: 23692 - protein, 80 aa, Candida albicans
FKHFFIQKLAVNFYMFVNNELNNSNSCILIIAFYKSEIASIRLPLDYLPVLETLVGVCLIFGPIYICILHEAEYTNTILH

SEQ ID NO: 23693 - protein, 66 aa, Candida albicans
HSLIKQGTSSTSTLYIERMTFHICKKWSSDYHGSQTVSIYPSQEYKDSSHALSTNTLFQAIDARHE

SEQ ID NO: 23694 - protein, 73 aa, Candida albicans
  UNSURE (62): Identity of amino acid sequences at the above locations are unknown.
FVLNSVGYGICKPQHLKIEFICFTKANTFRIIFALEPYTEVMDNHVIVISIIDTTTISIISXMDCGAKIKESF

SEQ ID NO: 23695 - protein, 100 aa, Candida albicans
TGSPPVGNTVHLIVDRLSVHGMEYRLAPSLHSNKTLERYVFRSDFIINDNKEYYEWVINDLYSRGESIMKWISHNRKINVLGDLIIVRMQTQKIQKKFLQ

SEQ ID NO: 23696 - protein, 98 aa, Candida albicans
MKLKVTDTKEVLYVMKFFSFLYERRRMRTKKKKIIISVLNMSVSVWRKKWFERIHTTLFTKFRDNNNIITSQNHITITTTTTKLKLQLTLHNPFLVLN

SEQ ID NO: 23697 - protein, 60 aa, Candida albicans
DRRKMLSTASLCTIDLVVSIGKINTQLNTPDIPPANNTENGEEIEGSLFIKLFIDHFMDS

SEQ ID NO: 23698 - protein, 96 aa, Candida albicans
AYTLVNSNGQANKETPPPAIKPDIKQTGIFRKNGCELSIFFVQGVSYNSPYVYGFTVVNKETLKDLDNDVEMIGAQIPRKNPRTPSLAYFFLTQSK

SEQ ID NO: 23699 - protein, 72 aa, Candida albicans
RNFQAISWRIINDSKGIFFYSVHYMIIYIYSIIKKQVDETKKHRGDNSSYNESMNTYNSSLFTGCDKDYLNK

SEQ ID NO: 23700 - protein, 70 aa, Candida albicans
VCDLQLSLFLHSHYWSISLYSPSYFMTCLNDYSLRYECWMDEKMKKFLVHFFLSKTLVRPVENCNSSGMF

SEQ ID NO: 23701 - protein, 65 aa, Candida albicans
FSVFSFFSSSLSHCFHVSFACNNRRIPLSTGNNTYNGANTEILLSIYENQLKTIARIYGNDKNKK

SEQ ID NO: 23702 - protein, 98 aa, Candida albicans
AYRPRRGEDYFGNGYNNVNQMYMYITTIQLSTFPTYDRFFLLHNACNKPLHKCVRTTSFILSRNLKNKVVEKFCQIYLLPSPLAETCQFTFKVVLEQL

SEQ ID NO: 23703 - protein, 63 aa, Candida albicans
LENNTILSVQEFLCSFLYDVNAKLRYAIIVESFEYVKNYIVLITKNFISCKNHKDKEEFSSTF

SEQ ID NO: 23704 - protein, 68 aa, Candida albicans
SFSKFKFFCLIFQINGALAKTSGSMTCKPRGDNKLRAYYQFMRLHTTYSPCACLPRTRFPSFCPLARL

SEQ ID NO: 23705 - protein, 96 aa, Candida albicans
TYISNNFSILLFFRHIRFFATIRDVQQNTNGGEQICKQQYTGIKNSHQESSNCQLLLIQNTNPYEEGKVGIIEYPTLGLLLFNIFDLPLEHTIVLL

SEQ ID NO: 23706 - protein, 61 aa, Candida albicans
NAQMSVGKMTVQISKLLYFLQILRDPSSKKFKLSFEDTRYEIIGIYSDNRKIEYHSTIDRS

SEQ ID NO: 23707 - protein, 98 aa, Candida albicans
VIIIVMVTVVLVVTCQPRIILIHSKLFQFQFRCIVTLLLCRYGLIQIGKLIDKLHYNSKVKHKHKTLDKKKKEMLLLFEASIAVAIPRLITYLIRNHC

SEQ ID NO: 23708 - protein, 72 aa, Candida albicans
LQKIEYAGKIIIWRNYWKCMFMDDYSSLQNHTRLQDVLWILTTTNYNINLEFYEFSCSTPVNSRMIFYFPVI

SEQ ID NO: 23709 - protein, 63 aa, Candida albicans
QQQLLLWVCATVSNNYSYGNGCSSRYLSTSDYLNSFQTFSVSVPMYCDFIVVQIRINPNREIN

SEQ ID NO: 23710 - protein, 261 aa, Candida albicans
LFIVCLSNIYLYKLASMIQQSTNSLDETESVSKQPQHQHHISPMNQLQSLNKEEVGKKSSKTDHIKQYIFKTVENMPTPKLMWLISPIAIVIYSTAFNIASEVLYSKFTYNSYGISFFKIAVLFLDVFIFLVVIYEQFYFTNDVHFTNKWSKYTYILICEILKKILWIILLIACVFQVIVISTGRLNNPLNIDNDYMQYFEMTPNEKTTYFIINLFSLIFNGAVLTIWWSTNISSVHSLFGLIHLINILSHRPHELKIRVA

SEQ ID NO: 23711 - protein, 98 aa, Candida albicans
CCGCFDTLSVSSSEFVDCCIIDASLYRYILDRQTINNQRDFNKIIIHFASNRGVSNVIYINQLNYNKIIFVNLKQILKKKILKNVPIIISIIKLIDNE

SEQ ID NO: 23712 - protein, 63 aa, Candida albicans
EICKQKIYDAFWYLVSYWMADTYAQYIIVETKMVLGKPLVQYTQIFRSCPLGAGGDYRLYFLF

SEQ ID NO: 23713 - protein, 114 aa, Candida albicans
QANNISLDMSKHSEDPIKGVKVQKRKVASIASTSSLTSTHQQLMNQATKMKRTKINEMKKQKQDFFKRINYSHLLTVVVLPLLAVLYVVLCKQSIVPENERTWYFTCIYYNITM

SEQ ID NO: 23714 - protein, 75 aa, Candida albicans
YKHTLKRLIWLLYRYQFIYLTQLTKSNKRHKQDATDITTTSTTSSSTCQQTTTKRCCCPNHFLSTNRYYYSNSII

SEQ ID NO: 23715 - protein, 66 aa, Candida albicans
VRDEPEPNKSKGNVPPDEPVSDGDESRELEDPDESNGQIACAWLIKMDPIISFKLTFIVGRKSENR

SEQ ID NO: 23716 - protein, 61 aa, Candida albicans
LKFPSCRYGRPRSQTENKDLIEQQRNRRASGATGKLSTSSNNDSDPDASTLGKSVNTHLST

SEQ ID NO: 23717 - protein, 85 aa, Candida albicans
LQHFTNTKKSQTLRHIINWKSISIKMKIISSRGMADREIDTYILSRYICGCVSVRVRVRVFFFWLVCLFLFLCHEGFFLYLFFFV

SEQ ID NO: 23718 - protein, 193 aa, Candida albicans
HLIDQMESTYTESTISKLEDKEETIKFDESELEEQLHRGRDKKRRLSFHSRHSSASRHKIFPIRESVDPGSVLPTVFRTISHNIDIEKNHQPIDSSDDNDDKVDKADAAAKTKFSNYSFNSDDIGDIVEKFKTDLTNGLSASQYQENLKTYGINKQSKPQSGLLKRIFMYFFGGIGLLLLIGGCIRFHWLGNL

SEQ ID NO: 23719 - protein, 90 aa, Candida albicans
TKSVKNILYIYINTFMLKLPYHTSIKTNTDYKWFDPVLFGSEAEKMYTLFLPPLFVHQCVRLLLLISLSNILYYYRGLKSRKHTLHTSHF

SEQ ID NO: 23720 - protein, 63 aa, Candida albicans
  UNSURE (52): Identity of amino acid sequences at the above locations are unknown.
SGVYFLGIRQYLLLLIYFNTQEFSVILKLHKSTKEKGEYLHDHRSVALIGPXILPFGAGDRAC

SEQ ID NO: 23721 - protein, 64 aa, Candida albicans
HITTYTTTEQPQHSSGTSMCLKNRQINRDRKRWERGVREKQRKKKEKKEQKSNGTKKKTHLLHN

SEQ ID NO: 23722 - protein, 128 aa, Candida albicans
KTITPNTLSILEEFNKRWNQIVQLLGIEQGQFIHKVILTHRYNSSIFSRLLSRVGLAIIKTTDDALNGPIYVASAGILHTQKSNYGVLITIRGTDEIGKELQIVVRCTGGGVAEVICSTLKEIFTGKF

SEQ ID NO: 23723 - protein, 258 aa, Candida albicans
FRNSSPIYPIMKQNYILLIILCYLLANVHSAPAIITVWQTVTDAQVAAGPTAAAPAANANANANVQQAAAASASAPAPVASPAAPAPVSSAPQSSTPSSSGWLSNLFNSFFGGSISDSSSGSDTASAAPASTSPQSSSSSSSSSGNSFLSFLSGLFGSGSSSSTPSSTSQQQQPQQGSPASGSNSPNSAQPDAAAASNPVPQSNNNQGSGLGSGFGSGFGSGSGSDSDSGSGLPSASSSTIIQQQPSSSNIGSSSTVP

SEQ ID NO: 23724 - protein, 61 aa, Candida albicans
MGRVHWEIKELPILFKNTNGGGIIYSTKFEFPVLNFKKPLHQIHYPFLKNLIKDGIKLFNY

SEQ ID NO: 23725 - protein, 102 aa, Candida albicans
LLSNLFSKPIEESPRHFCPLDLLYTETIEQGLNDLFAPISQDIYAKIDKLIPLKKLTTIYFNNPDNVFQKLKQYQKINNKNDLIKNLTSYSDVSQNLSLVMT

SEQ ID NO: 23726 - protein, 61 aa, Candida albicans
FPMDLKLPLDQVDPWMMNGQHVLDAPSYGESKKDKVLNRQNNVRDALKTIAGMVPSIRVSH

SEQ ID NO: 23727 - protein, 62 aa, Candida albicans
MNSKTRKEKEKEKEEKEGEGKGREMKKGRERKVINIFLLNEAKEENLRKVESNYILIINLLL

SEQ ID NO: 23728 - protein, 64 aa, Candida albicans
LIFLYLHFYFVTSIIFSIKLCLFWGIIILHQRSRISLWLKSFEKFFFYGNCLYINDVNSLSFYN

SEQ ID NO: 23729 - protein, 72 aa, Candida albicans
KFDLFSITNPFLNLYNYHILVLAIKIITITNNKTSITIIINFFISSFLFCNFYHFFNQAVFILGYNYTTSKI

SEQ ID NO: 23730 - protein, 106 aa, Candida albicans
  UNSURE (4),(11): Identity of amino acid sequences at the above locations are unknown.
TMRXLQIVYIXIISNLIYATSGGGTSSHHHKNDNNIADNTNNNNNNNNNNNNITNATTTRTVTTSTKTKTHTGGGVAAMGGILGQNGWFYGDAGLMAAIFGAMLLL

SEQ ID NO: 23731 - protein, 77 aa, Candida albicans
RGEDSLGLLPNKISSQFFPNGLDDSSILEMDVELNDNLIIIRNLLGEIYGLWVFNESDRIKLFKSIEFCLNTEASLS

SEQ ID NO: 23732 - protein, 116 aa, Candida albicans
NTCILQRKKKRVSKKKSIFQNTKSNLRQFGKLLEELLTIKITLITVFIYGLYIIQLKLASVLRQNSIDLNSLILSLSLNTHKPYISPKRFLIMIKLSFNSTSISRIEESSKPFGKN

SEQ ID NO: 23733 - protein, 97 aa, Candida albicans
SIRDKKPTFFSKFIIMFANKCDISFLFDIEEINQYDTIFDSNDIVYLNKEEIQHLPGDIFCKLWSKISGKELEGSIEEDQVEYCVYAYHRNVWVKSR

SEQ ID NO: 23734 - protein, 78 aa, Candida albicans
NKQACHFIIFLNLLFSNNYRSQVASVRLKSRIIARSIPNYGTWEHNKVLEIRNPRFSLNSLSCLLINVTFLFCLTLRR

SEQ ID NO: 23735 - protein, 65 aa, Candida albicans
KCLGEITLTKLKNYYFLSWSPYHDHKQLDNGYLTYHEPEVYGKKGIFEKLKNGQVLDELYLGCIY

SEQ ID NO: 23736 - protein, 72 aa, Candida albicans
TKNCQRRKLLLVRNNNNNNNNNKEEEEKPTHIHTCNKDKTTSYMYECMYVYVSNKACDHQSITTFTPNLFLA

SEQ ID NO: 23737 - protein, 173 aa, Candida albicans
YGILNKHQNEIMKTLRPISIFIVLHIIFSLSSWVIVSIPYRVLKMCIRLFLFMIYVFTIGVLSNNSPNSPPSFMKPLDQKLLFPYTTIFSKAINNRSIIECMKLSESTSFKIKNCTIKGESQYTSNGTGSRSIKDKSCLCYYIKLIQQECEELNSDQSWQLQLLQYPECFSTG

SEQ ID NO: 23738 - protein, 67 aa, Candida albicans
FISFQIFIHSFFIFFSSKKTMSSDVSILEKKDFFFERRETNYIIHILTILIPPNNFIIYNSINPNLI

SEQ ID NO: 23739 - protein, 63 aa, Candida albicans
IRDIFFFSIDVIETSSAILNLHLWLHPKNAPYLCTRPSANISFTHLLVYVYDTNILNQANFYY

SEQ ID NO: 23740 - protein, 66 aa, Candida albicans
VTMDQKIEKVALPTHQQSRVRERKKDVTMGKIINLPTIFIFLDLVQIILLFQISYSTSIQICLHKK

SEQ ID NO: 23741 - protein, 404 aa, Candida albicans
  UNSURE (322),(339): Identity of amino acid sequences at the above locations are unknown.
SNRGFFNTVTDSEYDKKWDIRNYLSSGFPDSRIAHDEDIHATVRIQKFFHPHTLPNDLDGDLWHLVKDNKEALDSFLDYVQQFQDYTIEVKNKMYTYYRCNYSHTNSGVSTKKADCKHKITVQTLKSGKYKIMWYLRHNHLIDPIRLAMLPKQPLPTILPWPGLEIPKTPMIELALENNKYKFADRASNKKSEANFDPDVLETLKNVLFNVKRRHEFAVFKKRSTNSENSKFCDVGNSTLNPESMWYFGIIHLSDIERIQNTQIVFLGCTTILSEGLYNDNVKLYSFFTKNVITGDGISIGYLMTNTDSHEPLASFLRCFVXRGIQIKKFVTDYSLKIXQAINERYNVGMPNQSQNFNALITFSTPQIFETFDYQIISLYKKPLPNDYYFPNYYEDLLLPNNFG

SEQ ID NO: 23742 - protein, 90 aa, Candida albicans
SIISNIFLLGTRSASPRCESKKKIGKQFKLFCFSSQTQNTFFQRITIPVFENMNLSSRRRDWRASIPEKFRTAEKFRTSRIKPKTPLIRE

SEQ ID NO: 23743 - protein, 85 aa, Candida albicans
QKNIANDTLICGPVDGRQQIRMGGGPDFILRGGKKNLQYEIWCDFFVFWYLQLSRIYQLQSAIHLNKLLEGKIFQFYPRNPFFCF

SEQ ID NO: 23744 - protein, 139 aa, Candida albicans
LALFGGVEYCYYYYLNNQMYSSPHVFVSGHFQQNNSQTKFIWLLSEISIIFQTIDERTISNSYIALDLYLVTNLMTLHFSKKTKEFHFIFFFFLLPNGLFVNWLVTCNPYSLFQVIELRPPETKNPILQRAANHANSHS

SEQ ID NO: 23745 - protein, 64 aa, Candida albicans
VWDLSFFAREPCKQKYIIKPTLDNELPFSGMPFGVVFSLHYFYLMPQPVIILESDDVICHQWHC

SEQ ID NO: 23746 - protein, 190 aa, Candida albicans
TLTTFPKIIQTHRPSKSIVSSPGRPATINHSNTESGSFFSKFSSLPKKTNKILNSANGNNSSGTDNSSTTSSSSSTASISVLLGHLKLGKDNNGNPTAASTSNLNGNHDKHISSRSHKISHQHLVHRSHHHHTNHHIKRTGTFHGVSVNDPESSNSSDVGSDYRSLNASPVSINNESGGTSSLKFWSRKK

SEQ ID NO: 23747 - protein, 370 aa, Candida albicans
LILNKQIGGQELYITMTLVSSPDESVNALTSTSPPTITTSTSTASTLTNSSPYPVSPRTKNAMPSSIFTSLDQTIGSSTATNSTCSPITRPSTPLLPPLEDLVNDCFLHSMGQLEDEGKIKVVQDFTDYLTKQHTQENLNFLVDIYRYEYYYKLKFDQNNNEQEASTNNYVSNGTLNCNNNESELNLRYHSCCSLESLSNMRKTRLIQSVDLDPQNAFVSTIDDLDDFGNANENIWDNLKDKYTCSDDENDNKSQDQSVNNPNDEQDPDIILLNDEWKYIMNTYIKCDSPMEINISQTLFKQIVQESAFSRLHHPQTLTKASKEVLRMLNENGYVNFNSHMKKLLRKQLKSPTSSTPILSPSTSPLPLHW

SEQ ID NO: 23748 - protein, 71 aa, Candida albicans
REVTAYLRTRIKPVPIKTYLQEKPAHRSANRSNSTSFVTVSIDNRLYKIVVYVFQTVKTLRLVEGWLIRLY

SEQ ID NO: 23749 - protein, 90 aa, Candida albicans
  UNSURE (88): Identity of amino acid sequences at the above locations are unknown.
SKDVKIDEGMAFLVLGETGYGELFVRVDAVLVLVVIVGGDVDVNALTDSSGEETRVIVIYNSCPPICLFSINYPERVLYFLLTKQNQXMN

SEQ ID NO: 23750 - protein, 250 aa, Candida albicans
RRVKTPRTLPNEFNGNLWHLVKENKEDFDNFIDYVQQFQDYTIDVTTRYTFYRCNYTNPNSRSGFTTSKSNCPHKITVQALQSGKYKIMWHLKHNHPIDSTRLSKITKQQLPTNLPWPKLKIPKPLILELESNKSKDTDEPSNRKSKTNFDSLVVSSLKTWVPYINSIGEFAVFKKRSINTDNNEFIDIGNSTLDPNSMWYWGIICSTKFQLIQNSQIVFLNCSSISSHKLYDDNVMLYSFFHEKCFNQG

SEQ ID NO: 23751 - protein, 167 aa, Candida albicans
IVPVFPVINYMMTMLCCTVFFTKSASTRDDGTPIGYLITNTDSYKPLASFLRFFVEKKIHIKRFIIDCSLEQVQAIKEGYNAGISNQGDHFDAAITFNPQHLFKVFNEQIKSLLKIAPSTNDTNHQSKDGELIFHKNTDSSCNQFKLTEGITTEQVLNNQKNWLLII

SEQ ID NO: 23752 - protein, 197 aa, Candida albicans
  UNSURE (71): Identity of amino acid sequences at the above locations are unknown.
RSSEFLVEMENKFKHYHPEFIEFIHKYFSETDQYWLDFYFDNHTEMIENYAYNFNEQLRTEYFQPENKYSXNKIISVLIKNIPQQQHHHHHHHQSHITDRAKPQLRHIDDVDDSKDKELDINESNFANTTNTSNNLRNVSKVKEPNKVSQELALKEIHACLAREKLNRRFHINERKYANNFEPPKPPLNFPHNGIAY

SEQ ID NO: 23753 - protein, 84 aa, Candida albicans
  UNSURE (36),(54),(65),(69),(71),(75),(81): Identity of amino acid sequences at the above locations are unknown.
ISHIMELLINNTNDSQTRADNISERENTQDVYSKKXIRNIKQREENSISLDIEXNRIKIEEKIGXMEAXWXSRRXAAKIPXRSG

SEQ ID NO: 23754 - protein, 79 aa, Candida albicans
SIYNIVHSTAKKTIPCYTQIKKLGTYLMMMNKFKPSVTIFIWLLKNENVGKQMEDRSMFELLRQRFWLNHQQTMNAEYK

SEQ ID NO: 23755 - protein, 72 aa, Candida albicans
VCFMTCVKIIHLHKLIEILVLRKKKKVNARPDLPSTETHIRFGCMIIEISDNYRKLIYYLRNTRSHFHITIG

SEQ ID NO: 23756 - protein, 60 aa, Candida albicans
ILKLRKLHWYLYITEFINICNTFYSKRNEILKTITLSQEQTNVVNEIDKQYKNKILKKTT

SEQ ID NO: 23757 - protein, 68 aa, Candida albicans
NENYSVLGQIIIIISLCYTPPPPPLLLVFPCVAQPFIFLLPPAPAKLSINTTNQPASSIIILFKNVLI

SEQ ID NO: 23758 - protein, 74 aa, Candida albicans
YLKQAHCKTTHSQILQIRIYYYEIDVSFQVRPSGSSSNVKRVYLYHISLTGNMIGKGKGNYSTQIRKRNCLHGV

SEQ ID NO: 23759 - protein, 379 aa, Candida albicans
IPHEMSKPPPQHQLKNANNSLSLPVSDKQSNDSRQLLLAHLYNYFKTNGLEETAQALLIECNNTIPKATTNSKGYSLDNSGPDQKDTFLDQWWGLLWSIQSSINPNLNQMTNPSGILTPQHQMIVQQRMLQQQQQQAQQQQQQAQQQQAQQQQQQQQLLQQQRLQQQAMIQQQHQQQLINNLSARQQQVGLSTTTNQMGPPGSNSNNLQSNMSPNNEQLQSQARLQQLKLQFQQQQQQQLQQQQQQLQLQQQQQQQQQQQQQQQQQQQQQQRQQQRQRQKKFQRQLLTLSQKLPVINNGQPQQQLQQDQRPALAPQNQPTPGNNNNNNNNTNAVSPKLHRQSVDDYQMNLLQMENQNNSQRQKYLNNQQTRNSQQQQQQ

SEQ ID NO: 23760 - protein, 71 aa, Candida albicans
ILFILYCSWLVVVELNTLINIRLTEGGKKFTPKRGNKKKNKKIKQQSRKSGGETNNNRIHTLKKERKKERK

SEQ ID NO: 23761 - protein, 72 aa, Candida albicans
SINQSINYCANQFLYPANILLLLLFLLLFRFHLTCLPLPPSYLFIFIKVLILHVIYQLTITRLSYFVSLFYN

SEQ ID NO: 23762 - protein, 85 aa, Candida albicans
LFSCNNNSGCFSSSISCCSSIVCNDVMVIGVELERTIDGNGDCVVDVVDDVVDDGGGTIDKLLKFLGIVASMAILFSSMISSESE

SEQ ID NO: 23763 - protein, 371 aa, Candida albicans
LNSFFYILGFFTTITLFFQISKSKSKSFRLLTSFINFTLLYSHIDSTTTTTTITTSAIMSLLQPQMSFAQTYILASKVRSTLTREAQSPKSSFRNLVVQANMLDNIMDYISDETKRRTSEKLTSKTNTQKSSSGYLSPESSMVQFAPTPVRQAYKTSITEYEIDSDSSDDDEEEEEEDHEDDNEDDYFYEDGQNDYDDLDDYEDSVVMEQDELAAIKGVYYEEDQEEEEEDNLSETSSIYSNSSDSDLDSDSDEYYIYSDSDEIIEENNIAIEATIPRNFKSLSIVPPPSSTTSSTTSTTQSPLPSIVRSNSTPITITSLHTIDEQQEIEEEKQPELLLHENNQTIDWKLKNHNHPQSLYKNQNISLDQFF

SEQ ID NO: 23764 - protein, 72 aa, Candida albicans
PTIGFIANVIVRGFPVDVDRVEYLNAADNPGLIVLAAYHISVPIDTTELSNLGITAGLILVKLCDVASPRLY

SEQ ID NO: 23765 - protein, 68 aa, Candida albicans
YDVNNKKNQLANVDKKGKQSNTEKEFQLINGDRYKQCWLGKIVGKLYGFDNLQTTNSNFLDLDKLIIQ

SEQ ID NO: 23766 - protein, 65 aa, Candida albicans
YFTFYPSLNNMVSLFREDPKHILKTINAHLPVDPRSLAKSVPLPNTEAPGFSPIYRNGFSPRCIT

SEQ ID NO: 23767 - protein, 77 aa, Candida albicans
NYKKKKDVLLTETKKENLMTIYRYIYTYIYVHQKRSNNCVFSNHVDSIGQIQSTGGTKKIINFKCKPLLYYFSELKC

SEQ ID NO: 23768 - protein, 77 aa, Candida albicans
SIPFWGFRDKTPLEEFNINIKGEELDLEVPPPCVCHLPNGSYYNLEIIMVKINCSLYRGNPGAGKNRSSKTNMPIYC

SEQ ID NO: 23769 - protein, 276 aa, Candida albicans
WVNQLMNYQKNKPTYLFPKYYTWSIKHIICKLITHDSDWIKVTNYKEENGLPKVMLKYDASSIFEKYPEIIEARRAVGGQPQSPGKNYIWVPQSLVEHYNPKLIDEYIESTKEKEYIKKYKSSPQKTTLDSLEVSPIKKSTLRGPVPFELKPKSPRKLSPNKSTSLSPRKRSKSVLLPGQKQLDFFLVKQNNKENAMKSIPELKPNDKAIIEDNPFLDSFNSTKEDERNKDNEEVMQQEEEKSNPIEKTITEESDSSELTFPTFLLDRIFLKDSEY

SEQ ID NO: 23770 - protein, 72 aa, Candida albicans
YTTREVIIFKSSCTGKLLKSGIAEVKALKPNPFEPLIEFLGEETLESIDVFRTVAVSILPRIFDTCSTGFIV

SEQ ID NO: 23771 - protein, 62 aa, Candida albicans
THQNHLPPYTTTLFTCGETYYWLIMMLAMGLCLFTFSKALKATYNLQPNKAFEHMLVFYKAI

SEQ ID NO: 23772 - protein, 395 aa, Candida albicans
IIGVMMKSTTIMARSISQDSRHEYPNSDTKLERTHLSDAQYIEQLLFENKELKALVDRQKKIIEKLNNQLKSSNGNKLTLDLINNRTPPLSQKSSLDNPEPEPEPEPEPELQTSTATEVCFKRVSAALSPTLVTIPKSPQRSISNHSMQLSPTRQILSVQRQENMADATSSDPVTQDIPLRSSRRRRNSNESKSLDKKASYISLESSTTPLQIPNSMSNESTLSSSYQTNGNGRANEYASIKSPDFEVDLGNITLKSDTINNTFDSKMGMDTTIGTVDSIDSGKINETVESQFSTMESTKSQLDISGSSTATGTGTGSSTLGAAASSSSTGVSKIYSQSKGIATSSSSVGSTYKSSRIKPPNLQTKPSNSSTVDLPHSPLLDNDSGCLPRSSSNI

SEQ ID NO: 23773 - protein, 73 aa, Candida albicans
SETKTCLHNNTYSTKSYPQGLQCYSNGIPSHFLTDIPLSKSINQTIKSIIRKTRNGLKLKMNYGAIFFFFNLP

SEQ ID NO: 23774 - protein, 66 aa, Candida albicans
QATTTFVTFYTPTYILPSSAAAIHHTHKTNLVNNLLSQFILSLGLIISISLSLSSYISLCFIHHIN

SEQ ID NO: 23775 - protein, 64 aa, Candida albicans
FLERYTLPTHTHTLISNNFPKPNLWLIYICLDGISIWYIIYFLGFDSLIFLFCWISKMRDFKFN

SEQ ID NO: 23776 - protein, 64 aa, Candida albicans
FQRHLLSFYIGGLLLLFLCPHLMLLLERKTTIEFILHHLILIFRDTKKGADANRIVLFICIICC

SEQ ID NO: 23777 - protein, 62 aa, Candida albicans
ISSDLLYCDCKINKVCMKKKKNENQKILREGAAHLIFVTVTVLSSPPPPFIVVHIVSESSKP

SEQ ID NO: 23778 - protein, 83 aa, Candida albicans
HHPKKKICHNTNDFIHAILISHEKYEMFQMCFNVLRKVYCYNEVFSLQFHYYYYLSSRFVYSINNFVPHLLFRREVNVRHSIQ

SEQ ID NO: 23779 - protein, 168 aa, Candida albicans
VSCVYRCSSYAIFFLRFVFGMLCYIPLKIQLSNDGYKSFKDYCCHLINGSIADAVRLHHKPKKVLLEQGILSEERIAQLPVLEDRPPRYNDYSKTFYRTDTSATLESNIPLNYMKDRSNSTNNSRDDFGGHSNQKVYSPINDQNNGIGKRLSQLRENILYCPRGEIRS

SEQ ID NO: 23780 - protein, 87 aa, Candida albicans
IIGVCVDVGSVFFFLTTRFLYRLESCIAKLLKDAKLVKLVKPPPILVIGLTHNMKVKQLFDFRSCYLDLKLIHIYMFSVKISIYKHM

SEQ ID NO: 23781 - protein, 78 aa, Candida albicans
HFKSYPTAVGADAKVDLKKNHAEFPAQLVPNILNLVQLGAGAEISASAKREDTVAAQIGANILNLIQAAVGAQTTVDL

SEQ ID NO: 23782 - protein, 198 aa, Candida albicans
YQFNTMKFTQVFTLGLFALSTQAAAIPQESTTEVDKRIDADVAAQLALNILNLIQLGIGANVNVTAKRDESAVTIEQSKRLDADVAAQLAGNILNLIQLGAGAEISASTKRDESAVDTVEESKRLDADVAAQIAANILNLIQLGIGADVNVSCKREEYVAAQIGANILNLIQLLLGLMLKWTSKKIMPNFLLNLFQIF

SEQ ID NO: 23783 - protein, 78 aa, Candida albicans
ADQMVFSIYGSSGPIKQYHTAHSSPIRGNSLVTESIYGVESSSSNLPPVKLTSPGSNQANKISNPFIDSSNNTFDGTP

SEQ ID NO: 23784 - protein, 183 aa, Candida albicans
PTKDFIRIINENCLPRLSGSLPPTPSKVKRGGQLYRSDSLHVIQSSPPSINKADNNETGIEIEKDFLTFDYENQDDILKAEEVYRNLYGISPNESTSSSKMTGISLCSRSLIAYNLFATPCQNNTEECGDSDDNLLLLEILNQKLKSKQSQSLLIIKLDPQSLNPSDKNVNVSSKPLRLSICI

SEQ ID NO: 23785 - protein, 60 aa, Candida albicans
WEEKITRGEPRHNCYAGLWRASFAWHLADPELLSDKLLALWSTETLVPDTTEPATKSSTH

SEQ ID NO: 23786 - protein, 94 aa, Candida albicans; identical to SEQ ID NO: 21810

SEQ ID NO: 23787 - protein, 138 aa, Candida albicans
FFSGNLIISMTSNLPPLGSTTNDQRLPQSGVSSIPTNKLPLPNANEDFATGVSNGDVDWLFRGKSKKLGKKMANNNANKDERKNSHGNIKNSEKTTAKPNETKHESNGEKLEFKETKSEKPTKHTTTGNPKAPTNGQI

SEQ ID NO: 23788 - protein, 169 aa, Candida albicans
YENLNSMLWTNKFLHLERDEEENNLHLLKIISHLQRNHSHLQFNAYIQITQIIPTTMALKKNINTKSTNKSSSSTSKIKKKAANTTSSKLKSKSKSTKIKIDKLNNDISQFTEVQNLLATNDNKQAPKKTRALDSIKEDLQKDEELKKKNKLVENDLNKQLELLTEMGL

SEQ ID NO: 23789 - protein, 67 aa, Candida albicans
RKMCAVILFLQQIIVEIERKINHTRKLTLVQQIQHHQQKEEATDKYYDNFPRSMKLPVDKYGSLIPG

SEQ ID NO: 23790 - protein, 85 aa, Candida albicans
ETFNPDSLLSIFFLWRFLIIFYYATPRQYVMLLLLKTWSLKYVSLFENDNYTPFQTKNYINMVRLEVIFQNCSSFFFFGFETVKI

SEQ ID NO: 23791 - protein, 456 aa, Candida albicans
SPIVSTKQVVCLVNNIKVATVDYDTGICPFQLPTTLHPSSSSSQFMVDPFFTFHSRDDYNVQFYYAIINSHRYTTDIKHGGSIISIAAKLLYDKHTPIYQVHLHKIPNSNSTEIIRKRWLFAKNKQIKLLLLSKILLKKDLVDDFIIDIAGSRGIMIDKVILSVVDVDQMTSSIATGSSNSLTRTGFTNPSMISTKTSNSQSITTTTTKGSSATTTTATATGATETITTTKIITITSCSNDICHLTTVPASLTTVTTTGTVYTTYLPINSVETVVSTKIITITSCSNNNNNNHVCHPTTVLATPSTMTKTIDNTITEYITYCPLTQQPEQLSTINPYTGASATSVTATITSCWEETCQTYITTTAAAAAAVIITQTEITTVETVTHDTTTYYVTYTITSQTSNQVHTTKINNEGGNTNELSSSLPAITTTVEGRGISNKIENLLSMLIMVMVMWFV

SEQ ID NO: 23792 - protein, 74 aa, Candida albicans
MQLVMKKKNFDNTSLERKQRENKYKERHTTNNTKSTEKTVYGCRGLIDNIFFLLLLFAFFGTLSFAECTKSSIN

SEQ ID NO: 23793 - protein, 83 aa, Candida albicans
TGVVKIFFFHHQLHLPQYNSSIRNYSNLVFNVVVSFQLNYMPARTGFFLCNLESHDVFHFQLNPLFRIREGKIQNACNSSENM

SEQ ID NO: 23794 - protein, 79 aa, Candida albicans
SWDCRIHSIDDNDRKMGFEKKKSRCIIKIVQILTFFFYNGLKLLQVVEVFFVFGGEEQPKEVYSLYWNKGGGGANNKRG

SEQ ID NO: 23795 - protein, 69 aa, Candida albicans
NIVNQNLSIFYYNHVTIDFYSCVRITHLSIHFLETIYKLVNYTKLNARHSPPPKKNVTTNNVDYIFLFW

SEQ ID NO: 23796 - protein, 67 aa, Candida albicans
  UNSURE (3),(18),(27),(37),(54),(61): Identity of amino acid sequences at the above locations are unknown.
HPXPFYLVCFVRLIYVYXSCLYREHFXFVLGLAPTTXYSIINPLKFNYPKFNIXHTKFPIXNTTAIP

SEQ ID NO: 23797 - protein, 300 aa, Candida albicans
LHNLHMIQQSSNMATTAVFEETNTDFDTSLMEFFYSTTSEDALPDVNDTSSTTITEVANEIPSLFSYSNNDLHPELDYESSSWYDITESLPQNIPDSKSEPIATNPTNVLTSPLQAFADFNHGSSTGLTTKQPELFHHNNNAINGSFKNNDYTTNKINTNTTTTTTKQRISKPYERSPLMKPSVTIASIDTIAKLKTKSKSNCKSSSISKPKVRNPFYKPFISSSISSETALKNTKIINFRDENNDNSSSFNFTDIDNKLTYDLSTETTNSSFPQTVLEALFKNFDDALIFDSLFDINQI

SEQ ID NO: 23798 - protein, 159 aa, Candida albicans
NTLPLMLIPFMRKSNFYFRFFFLLSCGNFIKFVVALKFFRSQLSKREGKKDAMQQQQQQREKKTVHLYPHNTHILYTDEEPPQNKKRGNRNNKQNTRKYRSARYHTIQYMRHLNKHCCLENLGESRCGQIKNEAFNSFFYCESINKHKEVPIYAIPSPN

SEQ ID NO: 23799 - protein, 87 aa, Candida albicans
KKRDYLLWFIKEKKKAEIILIAKIKAKHLNKYINQILANAKEYLNESNTTPLCLLLNVFFFSNFKTTMKMKMKKIYQNRWKKKKLNK

SEQ ID NO: 23800 - protein, 70 aa, Candida albicans
IICSSVRVTKSIPKSSELTVIVVEIQVMDSVTSGTIDNWVIRPVTTIMNHDSPKVNKSEQKQVQYFMQWE

SEQ ID NO: 23801 - protein, 60 aa, Candida albicans
KNVEIIIRKKKCSKPSMYVHLYTQMVKQYYDLTNNKYHVKNPYMELCLFFLFSKNRIPLP

SEQ ID NO: 23802 - protein, 71 aa, Candida albicans
LPYVLPTQTIVQDSFSFIASIDLDLGASFGSCEYVFGLSIRNLLTDDVVRGIKGYSSIHFSIATFISCKLL

SEQ ID NO: 23803 - protein, 77 aa, Candida albicans
KICWICVLYSRSVKDVWLTSGRARIKFNSSCLGVGSILAISEFEMVVPDKIALFSLVKFCGTQISGGKWVQYVLVNW

SEQ ID NO: 23804 - protein, 93 aa, Candida albicans
RIHNQGKYVKCLLKSKLKIMINFVQESKIISNIPLKVKDPLCCCHYLDGNNRFILKEFHHQKVKDTRVHLEDSEIFKEASDLSALNSPLYSFR

SEQ ID NO: 23805 - protein, 192 aa, Candida albicans
IGHSMGGFVARIAASRQQHESNVDIILTLATPHSDPFPWLPKTSDFPDEVGLISIYLLVDLMVPPLVVTPKSKSDHFFSVDAAKLLGVPIDHQGIVWCGQLREKLSEALIGISGLNTLQDRMKVFKKIFSGDRKELGPTPIFGLAKLKLKLLQSWVHLLSLTIFALKWTIIVLAIIQLRKVYTKFNNPPPTH

SEQ ID NO: 23806 - protein, 67 aa, Candida albicans
ICVLLRKVRLVYLRLLNVKIMNILKWINLKPILQLLKRIRRNRIGGNHYEDHEHLRLKNKSNYRQNM

SEQ ID NO: 23807 - protein, 68 aa, Candida albicans
LLNVRTEICYVVTLAKSQIVYLNTNRLRGILSFEVMSRFRVGLQNESIIFATIKLVSCYVIKPHEGAN

SEQ ID NO: 23808 - protein, 126 aa, Candida albicans
NQVMSNSPNPNNPNNHNLNKSPNNLPNNKFTNMLFSQVQTTLPPQFTEYPQQAFVQQTYQQQQQQQHLQAQQAFQQHQQLQLLMQQSGQHQHQYQPQPQQQQQQQQPFSFHSAYQFSNNNRFMPNQ

SEQ ID NO: 23809 - protein, 64 aa, Candida albicans
FLDMEAFTRVASGATIMAVITPAHVAFENNLYNAAKQTANFNGDAKYSPSCQQNQKIISMSIVI

SEQ ID NO: 23810 - protein, 155 aa, Candida albicans
FWQKNSLLTYLTSTQLSIRIVFEISICNFDNVSDCVLINQSVCHMRSLPLPRITRARKWKRIKRAIKNLFSKGYISDYGVFSRIQANHYSISKIRRLRFSTRLVKSRNDLNIVKRANRGFKLANYISRASRRVSVSGLKRGLRSPKSRMDFRINF

SEQ ID NO: 23811 - protein, 76 aa, Candida albicans
EQNQGGICHVGKISFVAVANFIDLEYWGGQRNTECLDKLQKPFDPRSEFWFCIYDDENSRCALQNVEPMALFEFLN

SEQ ID NO: 23812 - protein, 79 aa, Candida albicans
AFHTNQELALPIFTTLSLNAILDSYNLSCQYFCKKLDIGFIHNTFPYYKSFITIPFHTNTLTKTKHEVYSQHIMLTITN

SEQ ID NO: 23813 - protein, 70 aa, Candida albicans
KGDYTALSHQLKLIGILCLLSSAWLSQPSVEQLRECFYVYVYYWIIRLPKSFQQKKVGVDLYIQSLYNIL

SEQ ID NO: 23814 - protein, 79 aa, Candida albicans
NFIRGMTISKLSNKSLTYQEIFINFIKLFKRAKNFRDSILWKFLLGKIVKIKYDNNLKFHYLMLPQEYSETINIWKFVK

SEQ ID NO: 23815 - protein, 107 aa, Candida albicans
  UNSURE (2),(15): Identity of amino acid sequences at the above locations are unknown.
IXRALAFYGALTTSXPASKIGVVFGANTLLHNIVGVVAPVMIMNFYSKTLKNGWPGAVFILYSLLVLIIIILVVVSKRVLKLNVNTTDERLIRSNSSVSLSRSNAAL

SEQ ID NO: 23816 - protein, 229 aa, Candida albicans
NSSNLVNTYIFEQMSRFNGDKKAPHWTVSTGVFDDKLKEWKDEEEECFVQIKEIPQRRPKKYRPRKKYVRPAPPPQPQKWARPNYWSFSSEEDSFSDWWSSDCSESDWSSDDGGKLWFLGMNVAQGEPETKRISIIPSKKLVTRVSEQFYNTYRSSSPNNVMKKRNLDDSDDKYFGFDYEIQPCITNNLLRNHVTFNVLNSRSAKIKMLSRCKIKLLVCFFALHILFHS

SEQ ID NO: 23817 - protein, 229 aa, Candida albicans
MLKLYFLFCIFSFHLVIAPIPSINKPNSTDSIITRPVNINNQQDLQDLTFFSQVVLSTPNWDQTLTKYKRKKRDYNDDSLALMDTRNLDNNTFLMQGGKATSPKWHVGAGVYLNKERFSDTKKTYVKYESDYCSEEDYSSDEGGRKRKWFKPFSIDLNETKDISIIPSSRILSVDTEGNFVNHNKITNLTLGYHSENVQKDTFESCGNFKAFQLVYIVVIVFAYSFLHF

SEQ ID NO: 23818 - protein, 74 aa, Candida albicans
YILLEYRLRRLLVGVTFYQIAGTAKESKLVIWDELPNFFFWVVMIAAQVVSATSSDITPVITHIGKTSIQKIPF

SEQ ID NO: 23819 - protein, 60 aa, Candida albicans
SDSNSKKETDISNFNNLKGVRKEWEDEVEKIVVNFLLFFLTCFNNYYTTTTLINLINLIN

SEQ ID NO: 23820 - protein, 98 aa, Candida albicans
LYYTSGRELFIFLPNKIPPTYFAFTSLLAIFHIFKFSRTPPGSLPPPTFLFFFVHFFILSRFFYSNFIFIIFLQLIIVESLLEMVLVTLVKWLSYFYG

SEQ ID NO: 23821 - protein, 70 aa, Candida albicans
YDNIITPATTSPATPVEKLKKYSHPAANPNASSINRDESPDTPSITETKVTISQNDIIVHKTNVPTIVKR

SEQ ID NO: 23822 - protein, 64 aa, Candida albicans
IRCLEGKRAELQVFVNNYESSNFGNQDSLKEITNNGYNLSCQPTPSANSLGVEMSSSSDTFISQ

SEQ ID NO: 23823 - protein, 60 aa, Candida albicans
TCHNALLSALFKKYWLIILCNLSLTRYRKSGGKKKIMHNAIIEFLIRLNYTIILCGYPGY

SEQ ID NO: 23824 - protein, 65 aa, Candida albicans
IRCFLRRIISQPKLYKRIILTRTICNSFSLYHSNCQHQHQHQQQQQPQQEVAKTMYSPRGSKDRV

SEQ ID NO: 23825 - protein, 232 aa, Candida albicans
LRRRVENQEGLHHEKQKEHERKKQEDHEREKEDHEHEKEKEHEKEKEHEKEKEHEKEKEHEKEKEKDHGKEKEKEKEHEKEKEHGKGKDHGKEKDHEKEKDHEKEKDHEKEKDHEKEKDHEKEKDHEKEKEKDHDKEKPTDHGKKKEHDRFKYEDCDEFFEDHKKGKHGNDKRESKDNDDDEVTASIKIGKLKGFLEKGDKNNKNNHENKTVEEIDCEDQKENKRGLKPEFG

SEQ ID NO: 23826 - protein, 93 aa, Candida albicans
LLFDSKKIIKNKKKEIIDIYKFIPRKRYGFFFNLIYVFYDFKDLIQALICCYYYTEFDCKKPKTKKERKKKKDNQYYNNGIKKPQVLLIYFTY

SEQ ID NO: 23827 - protein, 74 aa, Candida albicans
VDPKVEPKGGKGGKGGIEKPYESGSESESESECECFEEEEKFKKGKDGGIKGGYARGDGKDGNASNRKSKGGKF

SEQ ID NO: 23828 - protein, 549 aa, Candida albicans
TMTHKWTPKWNPKVVKVEKVGLKNHMNLDLSRNLNLNVNVLKKKRNLKKVKMVVSKVDMQEEMVKMEMRAIAKAKVGSFNLVSQGSDKQQDELTIAKLKENKVVKENELFGMNDEIEELEKRAGKFWKWKGGSKNKEYSGFKEEDYIEEDKVSKKKVIKDKLIGKFKKQGDNEFGLSADDDPDDRDLVDELLLRVFNLLKGSGFINDIIRMSLTDPRVRLGMIDMTIRLLNAEVIPWDDIFIALKRHGLAIDVIKFTFTDAQTRVGLAAFVIELLPALVTSGALDLRQILETVPRLQEELIKMYNGGNRTHNSTDPADSGNRNHGFEDSVGSIIDSENQAESGINEHVIPKKNSSSINPISKETPTPDVPKVTIPSEKNSSDNYNDQVKNDGKESKSSLNDKEKEKPMNLPDVPLIDNPKNWDDKTLEEKVEEYKKLKEQYDEARRKLVTNENLDLIRDHTYFNNPEKLKNIKPLFPKTGVKYTNNTSNGTVGNHAAPYPRVRIFYDGTFVPNYPVDFKPPIAGGPLTNFEPNSNSIKPNAEPTVGVAT

SEQ ID NO: 23829 - protein, 71 aa, Candida albicans
SFLNQITTRVYKLFNKENKNQTNYHIQQTIVNSKFYVATPTVGSALGLIELELGSKLVRGPPAIGGLKSTG

SEQ ID NO: 23830 - protein, 145 aa, Candida albicans
NRKCDARKNEIIVDKEGEESRRAPAVSGTRNTQDSNRRASTKLEDDVGKRQGTNRIQRQTKPGREGPGEHDKRDQGQYKEQDDNTPNRPGREGRQKTEENGNRNKERAEKSTEEKRRRRETEGSERTREQKNPREDNIHIMCQTP

SEQ ID NO: 23831 - protein, 64 aa, Candida albicans
SCIVDWVQNDAKTRKKKLTYLTRGDALLMKRILHFFDVIYLCRALKWMSTNNSLIYKNGFEFYI

SEQ ID NO: 23832 - protein, 77 aa, Candida albicans
  UNSURE (40),(41),(44): Identity of amino acid sequences at the above locations are unknown.
YHHSLKVIIISTQYHKQFSSYAYIGNPFLLASSFRTMSVXXGQXDIPITPNLLGDMNFTDLDYTRNSESKLKSIHEP

SEQ ID NO: 23833 - protein, 63 aa, Candida albicans
DIYATEYIYTDDNGKLTTTTVLASTVTNPAVLQGTTPTTKPSADPSSSDDNSNKPSSSTTATS

SEQ ID NO: 23834 - protein, 101 aa, Candida albicans
QLPLFLPVLSPIRPCYKELHLLLSHQLIPQVVMITATNHLLQQQQQADNSESSPTGFFTEIKVEVPEGVYSTSTKYTHTVLDDGQTAALELVVLYTAFCEV

SEQ ID NO: 23835 - protein, 73 aa, Candida albicans
LRYLLKLIPFNPKSMFIPNNNKKLPPMKKFNGVDNICPDLPFDFSMVIEKEVVFFIFKQPLNGIAFLLPKLKP

SEQ ID NO: 23836 - protein, 330 aa, Candida albicans
GKTSNLDADLNKVITTTANTNSDTHSINKISNTIIRFNETNSTFFIITDPNGDFISDSIELIEVDFGDYNYLSSNYNESKLINTNSTNDNTINNKFNPNNNETDGTFSKTINYGFNFGNKNAIPLSGCLKMKNTTSFSITILKSKGKSGQILSTPLNFFIGGNFLLLLGINIDLGLNGINLSRYRSHTITCRGGTASVAAAGIDFGDKLINKPDRIEGEIIQILQPFNKNIISLPKSKYRLIKIEKNLIHQQNLATNFKKLHKHISFKKNKSTAKSFVKYEFNYVTPWKKLFTNGFKKDLGIILYLDDDGANNNIPYCESRPEYLQCNVF

SEQ ID NO: 23837 - protein, 329 aa, Candida albicans
MSFLRRDKSKANFRDGSATGLEEPVSPTTHFSPNAPPPLDGNHGDHYHDPDSPRSSVVSLPQLIHNSATHHLKENYRGFHANKRPKGIANVPPLAQPIKPRFKKKSNSLLNKLIYSTKKEDDETATSGKESRSSSIISDEKRKSASLASSGSSRQKFRFSSFDSNLSTSSSSPPKDKKALISDTVSDSSTVTASMSNMPTISIDLNLDEMHDIIKSPETPAPTVGLPTQKAEKKASPTAIKNWQAPESWDVKAPIKKEEPHAPKIEEVAENDVAIDNVLEKKGLPVLYGTHQVPHVTNSKDISSSHIIRVFKEDYTFTTILCPLGNNHQ

SEQ ID NO: 23838 - protein, 124 aa, Candida albicans
GTLGCKTFFAFLLVLYNLSAVRVKKSNFTDNLKKRINKILIYYYDQHIFNLVPIFYYTKKKKKKNLTHSRSTFNPQSIFTIPLFLNYFQFNHSSLNNLFILFCIIVIVCCNSIQFNLTIHSQFK

SEQ ID NO: 23839 - protein, 64 aa, Candida albicans
KTFELSACPDFTSYVCRMYNFNNWSLLTVSNEQSKRNSTISFHTQLNNSNKMNLVFIPPQNLHK

SEQ ID NO: 23840 - protein, 62 aa, Candida albicans
KIFLPSFQFIFLSFFQKDTFFLISDLQLNMTIQDHNTIHPNVIQDVSTEAPGIVAGELICIT

SEQ ID NO: 23841 - protein, 68 aa, Candida albicans
CFENFIHMDQYQHQKQPIIEIDDPNGSYALPKTQLYTVVFQFIHWHLSYQLWMETVVTTLINFNCFLN

SEQ ID NO: 23842 - protein, 126 aa, Candida albicans
EKEEKKLHLKKKKIVSPKYLFILFTIMEEGEGLFVQSDEESDYDEPATKRVKIEEDSDLELNESDWEDVFLDNIADPAPSEFSITIQQNDIDHQRKERIKQLIREKQKRVSIHYLSMVSLYNPCKV

SEQ ID NO: 23843 - protein, 61 aa, Candida albicans
YFCNYDLLKIIIEAGFGLTWLSVNMDYKNRKTGTSRINFYSLKGLRVIRLKSYIAAIFFKL

SEQ ID NO: 23844 - protein, 70 aa, Candida albicans
NLILQQSSLNFNLKNQNQKKEAYCRDLRYGIWPWAVLCYVKLGYVVLLLVRRHGGGRAPPSPKNETEGNY

SEQ ID NO: 23845 - protein, 60 aa, Candida albicans
DRTQVHYNVTRFRKKKKMSKNGKAERHTQKHTNPQSPHITTHTRQTTTKKKKDNKAQKKQ

SEQ ID NO: 23846 - protein, 60 aa, Candida albicans
TVSFLLEKNYLPSLFFFIFIYLFHFSFFYLTKGIIVKITSSYMSYYLLTHNHKSYLQSVH

SEQ ID NO: 23847 - protein, 67 aa, Candida albicans
FRRWSVNLPKGEIASDIHKSTMEMYFRVMCLAELVTLGIGVIVVTWFVVSVVANYCLSENWFSYSKS

SEQ ID NO: 23848 - protein, 77 aa, Candida albicans
ILSFDIQSKVTAIWSKPEQHLPKLAPGTKLKTSINAAPILDKIEPYDQNNELSRIGNSWYENIIRSRLALTNLQQFT

SEQ ID NO: 23849 - protein, 76 aa, Candida albicans
YLLFSALGDIIFINIQNGFAYIIFSNLNLATLALRDLINQDFFDKPLVLNYAVKECKGPSLFHLEGVRHRANLWGM

SEQ ID NO: 23850 - protein, 85 aa, Candida albicans
LPTHTKNNYPGHQPNIESILQPSMRDGIIKGRPFFILADEIKDGTAYYTVVYGSGMHETFSEDRLRKLSPEAIGNFKQRRINTNT

SEQ ID NO: 23851 - protein, 351 aa, Candida albicans
GNRNGENLKDGDHPPVTISLKNLKCLSIKSYDFDSIHPYNLELPAGLERLELMYLTFSDGYFHFGDNLRYIGIYTPTLTFHEDFRLPQSAQEFILNADCLTFDRLYFLHKLPENLVRLHLIANKLCVMRPITKKIQWPSMLSSLYLKGFAINSGILKLLNLRQTCLEEITICGGYVPILSEEMFPVSVKELTLQRMGIRSLSSSFKSLKNLQRLSLIRNNLKDISSVRLPLATLKSLDLSYSHVPLLTPFLIAFLSEKYKNAELEVDARGNQEIDINDVLMAMQEYRRLSVCLSMINGTRTQLPMDPTRLEFVYESFDSYHERYENSDNDPDDMDSDVEDDDVERRRMGLH

SEQ ID NO: 23852 - protein, 66 aa, Candida albicans
YINCFINYGDTLLILRGGGGTNSLSHGLVTLCGLFFLLFPFVVPALEVFVTNKLFFLALSANFRST

SEQ ID NO: 23853 - protein, 64 aa, Candida albicans
RMNIKYLYYVVPIKVETVALLFSPVGLCTILCQKLIYENDGYYENGKLFHHTSGDDRTKLYCIV

SEQ ID NO: 23854 - protein, 355 aa, Candida albicans
EEKKGSYNRKRFRLIHHQSPQMITRNILRLSIRNWNCARPVTSFLPCRRFLNTTLPRQLRGRSTINQLIQSNTQLTMFPIQRNNRLPLRTIVILIVASSSLTMLLFVAVQYKKFQDELLPDGKSRKRSIFLPLWFNGNLLYQTTYGFPHGLKYFDPEFYEYIMTEVQQLNKDGEIQGHHDNSVKQFCHALQEKNIKYAVLEGLSANREIRQIFGLPLTVDTHPNSDGELKIWVESKYPSVSGLQIDITKTVDTNGSNNSKFDFHWIVKPINAVSVINSAMTLTGLGLDRLESSEANIKTHEQGSGKVHEVKMDKEKVNLNKQRDYAIQFHGKLHGVRQVNGESWIFTPALEGTAI

SEQ ID NO: 23855 - protein, 79 aa, Candida albicans
CITKYCCAFSQSALSLWYELGQMSHTEKHAKKYKIELRRKKRELQQKEIPLNPSSITTNDHTKHTTTINQELELCPTSH

SEQ ID NO: 23856 - protein, 62 aa, Candida albicans
PFSIDAEQSHVLLPSSLKNKETCMGKTGCKIVFIVWMCASWTSSHMGHINDCPMFMYGGQVY

SEQ ID NO: 23857 - protein, 78 aa, Candida albicans
NWNHTFRLITIRKENAGYEKQLVMKNTALFWFDLRNIESCLFIDFFQKQNVLKKVFKKHEVIFSDYLGQGEHPMFVAL

SEQ ID NO: 23858 - protein, 92 aa, Candida albicans
PYNMLFLLLIIPLTISYNPFKTKSITQERLLCKNCSSYFPNHPPWNLSYAPFTVICPPGELIRSANNVRSILFNSNSYIAVVILSCLVFFFY

SEQ ID NO: 23859 - protein, 122 aa, Candida albicans
IQLMSEQEEETALKSQEIETPSESIEKNGQKENTTTDNTLNGNKKSDDSLQPATEEELHQPENVVQETTNIEYVVEDTVPTSDDTDSPKNTENNKPNTETDNAFNANIEGTPRSINSPESDP

SEQ ID NO: 23860 - protein, 63 aa, Candida albicans
KIQFLLRMTQIHLKTPRIISLILRRTTPSMPTLREHQEVLTHQNQIPDTVINPAEDVSVQSTP

SEQ ID NO: 23861 - protein, 157 aa, Candida albicans
VKTEVCYSLLLLVCLFVCFCILTEFEARRFHEYQKRLESKNSAYLLDKNSTKFYEELRQRDLDEERKIKLQEAIELQRFKQLRERKKALSKQTKNISLGSISKPAILPRKNLQKARENTLERRLLEQSSTKDDKEEDNSDSGKNGILTGYESSEDED

SEQ ID NO: 23862 - protein, 61 aa, Candida albicans
VFSQVDHLTTTRTHTCKLSNNFLVAYFVVFVFFLVTPELKKMEQRKSNPSSYRQQEKELVR

SEQ ID NO: 23863 - protein, 83 aa, Candida albicans
HVDNQGKEIERIKIVAKRPTCVTIGSGIKNNEMFVTTGHLKLDDEKATIDATNLDGDLGGFLFKLKVDKDLNGQKKNIWGGKV

SEQ ID NO: 23864 - protein, 67 aa, Candida albicans
PNSGWDEPTKILHLRMFREDNVDTVGLREKIDYKKNKKSLNGEEIFFFSSLICGTRSTKKMRQTDEI

SEQ ID NO: 23865 - protein, 83 aa, Candida albicans
NRKGVSLEKVFQCHENHGAHDHEESLLDIEHIKSRLQKLSVEQMDGVSQDVYTDADEIHPGTDQTHALNNTFDEFWKNLFRLT

SEQ ID NO: 23866 - protein, 338 aa, Candida albicans
DINCNKKKREHNSTNNNTQDSDLYDLPFPLTYIIYKSILQFMLFQVLFIYLFHSVFHSFLHLYAYFIFVLLLQVFFQLLLSNSTIKLLNRHVIPAINSSICFKKMSESSTSSIILRCSVPVISSGLQSLCITLQTKSHLLHIQYLPLDSTIPTNSNTNNNTNDIDDQQHEQEQNLRRQIHLNHQQQKYKRNMWLFGFLLFIIANVLGSIIQISTLPLIILSPLQSIGLIFNSILSCLLLPGDHFTNKLWVGTGIISLGAIIIAYNGNVNSTPSNSPLKPLPPIEERFHLILQKLINPSFVIWFIGTFTMMWGLLLVNYIYLNKKIRQLQTRQPFSIIT

SEQ ID NO: 23867 - protein, 65 aa, Candida albicans
MCNKCDFVCSVIHNDCNPDDITGTEHRSIIEEVDDSDIFLKQMEELIAGITCLLSSLMVEFESNS

SEQ ID NO: 23868 - protein, 80 aa, Candida albicans
LSIKNITWFLNEITHLFDVILPLLFPLKAKLVCHVDTVLIGSSIETRSVFYTIHDFVLHHFFKTQFDFVLVGGVAKTSIV

SEQ ID NO: 23869 - protein, 111 aa, Candida albicans
HYSYYKLTTLIMEQELTQIINLLTSNELPTTLTGLEQTHKLLMSLLPSIKQYQNLLTNTNNSALMYNQRHIKQNRDLQQLIQFQILQDNFQYNVLQYLLPIIQHAAGRNRT

SEQ ID NO: 23870 - protein, 84 aa, Candida albicans
KPSCLYLILLFESKKNTSRDFDIISSSSSSSFGEIDWKLIVYDLNQFGNPNERIVMFFGNFYTPQTNYSFDTQKEKLKPTKNVE

SEQ ID NO: 23871 - protein, 90 aa, Candida albicans
NQFRRELTLDQKIEIQKHIRNKLRPRYKPNEINTTVRNGEFITSEEDYIKINKTISRKIYNYILKQKLGEIDEFFTNEDKLRNLIDKYIE

SEQ ID NO: 23872 - protein, 358 aa, Candida albicans
SCEMGLFDLLPFPRGGGVADSTTTTIPTYDSTKDSINLQVKSLLYLFKRLKIYQLASFLNRDNNYELKYIGNTTIDNTNPIHIKLDKIYNLERFLQILIYEDEYKILVDFTKNKFRSLCFMTEYPYGKVLVSMATGSFPQFIDEDEDGDSFENFKFILFPLKNVTIEQMGRLLTKSDIYIEHKNVSTLKRYMIAIESINEVLGFDGNKSDITIFDITITQKNQIIKQYLIKLAIQVQLTRIYQEYIKQHPIVITGDPFVTPPSSPTKKQSILSISPMKKIRTLRKSMSNLTLNGNTSGVNYNKAPSVPSVPSSPTRLRPQKSMSKLNSKPSILKMKLEELYNPVASPRGIFTTGLEGT

SEQ ID NO: 23873 - protein, 85 aa, Candida albicans
NWNYQAFICMFYCFCFERSKDGGRDILYAQFFNVDKRIKMNLQEFKQGVQNNPIDSLFCCGDATDKMAKSYIIEDKIECVVLCTS

SEQ ID NO: 23874 - protein, 61 aa, Candida albicans
KLDDFAMCFIVNLDRTIEIDGLDGGISYHYHQVIQKYLVISKYFLKENNSIGKEERKKKIK

SEQ ID NO: 23875 - protein, 64 aa, Candida albicans
  UNSURE (63): Identity of amino acid sequences at the above locations are unknown.
IKSSHVMHYLISSEKFNSYLKATKSVAKCLITIARLHSDRKQMLSSILVVKMMMFTPWGQHSXL

SEQ ID NO: 23876 - protein, 79 aa, Candida albicans
  UNSURE (19),(21),(65): Identity of amino acid sequences at the above locations are unknown.
LSMIVIMQKPKNPSLDSVXTXGLVKLKLLYCYTESMVLSRSPDWSKKTNSKINSIGWVPNVKRPXLLLSLSTLNVMLTF

SEQ ID NO: 23877 - protein, 76 aa, Candida albicans
RMPMYVYVYVFVFVAFFFCIYRSLDEHYACSEPPLSELNPVLYNYKNRNHTGCNDKEAEAKRLNLGKPITQSRNSV

SEQ ID NO: 23878 - protein, 80 aa, Candida albicans
VVCRSQLFVIPLRRKLVFHFFTHESSPEIWLAMSHICVVENMHGQSIIIRKFVKSSKKKKLENTKFGSADFNDNPISSFT

SEQ ID NO: 23879 - protein, 63 aa, Candida albicans
STQVRFPFKVNLAIFQVGKNVLRMSKKRNRGNDGEKERGGRVHKCETHHVSSMYSIMVFCDIL

SEQ ID NO: 23880 - protein, 420 aa, Candida albicans
CDQVRPKCEYCAHTNRECIYPSDIPTSETNAEKDSPVEDIRRDLPLTQLTSVLSVSQLELRALKFFNDIGKLIVSYKNQRYIDNWEAVINPLLFQSPIVKKTLLATSSMLLLHFMNINTVDSKVLTSSFSVDSSQEAQAFFQTGTKYLQELIDERKHLLQDNSGFGIERIIVNDLITFGCLLIYNHKLVPLISATGYDVISMAKAYSDTRKMYSQLMTGLRLESLFFPKSNPILTCPPETNYWFTRVLELEIVAFVSKNGNKSANMEEYFQALMDTFLLLKDACYAMAIVRFPFPLIACLTNFSDKYRQLLRNGDEFAFRLLFIYSCLCVISRIPLNRNDNIFVDYISEFKNIIFSKYGEFSYPIDRELYHLVIRTNFVVDFGDMTRFHPLQQCEPLMDLSWLERYIDSLEKTNTLLQCI

SEQ ID NO: 23881 - protein, 74 aa, Candida albicans
KIFRNPPIHSPPSKIDQQASKHKVNGLLLLLFYVFHPVDLFSINNVPRFLVCIVNAKVFIHKMNTTHSIDIIPT

SEQ ID NO: 23882 - protein, 122 aa, Candida albicans
ESKWKKKFFSTIKNLLTKAIIYNNYLPMMPKVTSIEKFIELSTDLLANYPTTTTLSTTYTNVSKKSKKSTSESAATSKPKSNKISTHAVSFKLYEPNSGKCIRYTTTKCKELSRLVHSLSHY

SEQ ID NO: 23883 - protein, 67 aa, Candida albicans
KLSTSSKKKKLHQTSYTMVSSSSYYWCSSASVRETVILNVTGTSSLSILNALNVSLFYRMIHRNLNI

SEQ ID NO: 23884 - protein, 62 aa, Candida albicans
YTVNGFSELVLKEVVDLGEMIEEEKDADGLNDLIIDLNIVIGASVIKKLKLIIGGRQERKKE

SEQ ID NO: 23885 - protein, 114 aa, Candida albicans
YQDQPIRIIEELSNMILDRYSISISRETKLCELMFYDTDWLNIGINKKEVPSYTIDALRKLIISDSSTSTSLAKGEKLRVCTRCRAVSLVGDVTGLWTMVFQRTCMCGNAWVNV

SEQ ID NO: 23886 - protein, 185 aa, Candida albicans
INLIMIAKKKRTSICFSISFHQFLNKLYNYSFFLSCLPPIINFNFFITLAPITMLRSIIKSFKPSASFSSSIISPKSTTSLSTSSLKPLTVYHNSNLLVSHQLVAKLNNFNSTTDSPTNNKITFNLKTNEQLSESDYKFIIDECLYIHPDNKSLLLQIFHNKYHMDKKKLIKDFTLHDSIFEYTI

SEQ ID NO: 23887 - protein, 86 aa, Candida albicans
LVYERVMWLCSVGAMSQRVCRDVRGGGTLLGPSHLLVPLSFLLDSLARRKQAKKKNLTEVKNKMASENILKGGEGREKQKEKGGDS

SEQ ID NO: 23888 - protein, 93 aa, Candida albicans
IHNLINNNKSYPLIIDYNHCLIANDDASFDRIMMNYLTCGIQNTTSSNSTAASHGFTTNGSSSSSGNGGNNSTGTVKYNDLVHPHMAEFADLF

SEQ ID NO: 23889 - protein, 62 aa, Candida albicans
ENDSTDYARCDSCTANENIKIGLNESDVSVGIVWLLSRCERRQSSVVYCDNVALFDLNDYHM

SEQ ID NO: 23890 - protein, 70 aa, Candida albicans
FLQSTISTTNLLFIHYYSLPIEQALELPLMKRFIIFYRTVDSLAYFFTFSRVSPPNNHFVVAFYMMKKRT

SEQ ID NO: 23891 - protein, 92 aa, Candida albicans
IKYVKNTLLNCNHNTKKDKTKLVDFKNNTIDIIIRYILLSLSLLYILDNFTFYLVYHLILILTSLIQKKNFPFRSYRYNSTLFVVVENNSFS

SEQ ID NO: 23892 - protein, 80 aa, Candida albicans
GSVQTVAETAFAAYAGECQGSGAISGGSGSGSGSGSGSGSGTSTITTGGSSSGGSSGGSSHGSSAGPCKKRRRRRRRSNY

SEQ ID NO: 23893 - protein, 60 aa, Candida albicans
LDLLLLLLLFLHGPADEPWDEPPEDPPLEEPPVVIVLVPDPDPDPEPEPEPDPPEIAPEP

SEQ ID NO: 23894 - protein, 80 aa, Candida albicans
QYKKRKNSLTKTLSILCKVEKCGKKRSGKRNPVVNYICIEVSHINPNQRNTTGGKVDSIYCKYDKYLEEYARGVDIFGIY

SEQ ID NO: 23895 - protein, 65 aa, Candida albicans
VMSAIIRQAIRPALRSVSSKRIAVTALRYNSTAAEPAKAPVDAKITTIVGSNFNFDSFRNLTINQ

SEQ ID NO: 23896 - protein, 65 aa, Candida albicans
LKCHKNGVPINTYCMILHPIYIQKFVTIFSKTETFAYASENTINISYLPIIQALSELDLSSYNSR

SEQ ID NO: 23897 - protein, 146 aa, Candida albicans
KIMNLTSMCSSISIVSDYLLPTTLLSTCNPHCYSFSIIKADSQIHDGNFVNINYLCMCENTEIWHHYENCNCYDTDVKEVSSYVCNFAETALYLSGDYYETFLASNTEDEYQSVSESNEYLDRMKDYITAGLVSRTTTSKFPSSFL

SEQ ID NO: 23898 - protein, 65 aa, Candida albicans
KSAKCADIDADVDLLIEKFDDVKLGEVADKVKDADAASVKSTFVEVAKELVGAGSLDASYLKYFN

SEQ ID NO: 23899 - protein, 74 aa, Candida albicans
FQLDKEKELEQAFKKALENPRKPKPIEDKTTSGFLDIFGGGGGAGVRQSIHIDRNSDPKLNVWQAIKDVFSLGK

SEQ ID NO: 23900 - protein, 61 aa, Candida albicans
MFHNQFVLCVRYRTKKLEASEKPVGLKKNLFFYFGRVASILDVERKKKKKLRLNSNNNNYH

SEQ ID NO: 23901 - protein, 71 aa, Candida albicans
LTYPPLSPCCYCSSCIKNRLTRHQMNYNYLFIVLNLFYIWNFVYLNKKVKSGKVHHHYYVKHFVRVNYRNN

SEQ ID NO: 23902 - protein, 62 aa, Candida albicans
RQEKTQKRKNNEESKLQNKGSSLHRNLKYEIIVITLIVSVINSHKMFNIIVVVHFTRFDFLV

SEQ ID NO: 23903 - protein, 81 aa, Candida albicans
KWRQNINYNSFYNCIKKPHQTSVTERGGQPLIFSILDSKIQNLDAILLIHHVGGLSIDLQMILFHKIISQFSFFFFFYFFT

SEQ ID NO: 23904 - protein, 80 aa, Candida albicans
VRIWADLLGVYSIIVFLKVHSYYYVPISRCNVNLIKITSSSPPFHFSHRCCCNVLASTQKKRKTFSFPKNLKKRIFSPIF

SEQ ID NO: 23905 - protein, 67 aa, Candida albicans
LIIWDQTFFFLVISSDEVCNKPKGGRDGDVLRLRKKKNFHLFILQLVLQKKKNFFAFSNYSRILNST

SEQ ID NO: 23906 - protein, 182 aa, Candida albicans
IIVIKTFSTKQNSNYSTMKFIIILFTLILIVTAAQRIYNKDYLYYGCNSYCDKALDQEDACGYYDDDVSYQDYYGCLCGNEIFLSNLKSCDCFTSIIASVSKSVCSKATEDSDWGYYDDSTLSIMDFFTADNTPASNTGMTTQTDGAINDNQNTGSKTSSGAANYLTSFSIGTFFVFVLGLI

SEQ ID NO: 23907 - protein, 532 aa, Candida albicans
  UNSURE (525): Identity of amino acid sequences at the above locations are unknown.
IGIRWGKILGTTASVKHYDSVSVGHSNNSSWDNRNVSDLRRFVRDESVSSSSRSERNVPRSRNLQHSLSSPLTVGNNDSPNSTNNSSAGNTPSLLYDNTPLLDVLKQRELSNRSGNSSPTSLYDSSNSNSISQLGAPVKPTLRDISRSSEMSSEEEIFKTPVSSPDQELFKEPKDTPKLAPPSPTSLKTATPIVTPPNKINAFRPPRISAGSILDYKRLNTDTSISTSTNSSSSGGTSNRKSQISLLPEPTIDTESFVEQYFHDSSPELYQLSEIISNLNSTPTKTHHQQQQEQLDKDQIEQEQKEYSRLINEKRQLLRSSSAGAPVKEHIIQVSEDQAIKFIPSPTDSITSTPRSSRYYDISSSTFNKFLNDKQVDIPPRGDVMIVNNNKIRKHHRNASSTSSAGDFFNPQKKTPVNASADPAPPITPKRSPIQEVTTPQITGDSPPPPPPIEKSPGMRVKGRPKKKRSKKHGDKKSDTDGKDESHSSLKHKPSEKVSGNAIGKKKEVEEFTIPIAIQTPPYKXLPQQPFL

SEQ ID NO: 23908 - protein, 79 aa, Candida albicans
VTPVFFNDKLPYRGLRVVVLYNTSTPQMIFAVAKSANACTRKHGLNALSLWGAIGRSSASIPHDSFGYLGSITEKILKR

SEQ ID NO: 23909 - protein, 80 aa, Candida albicans
NKKYFILDQDEFCFQFLINPHIHIRESIQLYLTVFNKPNNYTSFFVFLIFPTTFFFFFTFFTNKKKRRQHLLIVVSRVRV

SEQ ID NO: 23910 - protein, 65 aa, Candida albicans
KQVYNSINLPTNQLNNLLYNYFIEINLKTFLLWRREGTPFGCNFFSFSLSLLRFAGQKKFCFSSI

SEQ ID NO: 23911 - protein, 292 aa, Candida albicans
TTTATPLPPPFSHIHTMDVRRCRRCKRKRLDDEPDEVRQYKTCAKCRIIERNKKNLRKPLAEETMLYGLKQFREQQSAENYIEEEGLLKDEFFKRYHNKPFNYQEEITKVLNNPNYVPPVLHNHNTDEVVTSSNGNTTGPKYQMTMKTNNTTGVQPPIKSRKQQQQPQPQQQQQQTQQHRHQQHQHQQQTHHHNQLHHQQETVIVDDEEDLYKILSELGNDDNSAKNDSKIIKENLDPYANDNVYDDFQKYLTTILEKLHSDKDIKNLVYLKEFNEVLYVLTTGKKYRVLSI

SEQ ID NO: 23912 - protein, 80 aa, Candida albicans
NNDLRPFCSSIYRSRWQILEEEERKGKKKNKTFLRWRPTDRSCRDPFSKTETGLIGVNHQIMKVCHRKLRTFYTESFLVN

SEQ ID NO: 23913 - protein, 70 aa, Candida albicans
WDDFGAADELPPPFVVVVDGVDDECSCGCLDEAELDLNFDESELNNPPFLLFERETLGEDEFREFELFDN

SEQ ID NO: 23914 - protein, 74 aa, Candida albicans
LYSYCGSCSLSKTEPNGKIICLKKKQNKMEHSDGFILPRRTHIIVVISFGQGFKQYKFILSNILTHHYFILHFQ

SEQ ID NO: 23915 - protein, 79 aa, Candida albicans
VEINNIPTDGQSINEHVPRLGQISLLKQTHPIKKSNSSKYLMPGIGLPMCLFDNSLILKQYANNGKYEKLVNADYSRTN

SEQ ID NO: 23916 - protein, 71 aa, Candida albicans
TLSILEPQIETDYCYGSFPSRKNYPVKLLKGSHPPRITLYEVNSTKKGNSSFSITGIGFPKGFLYLKISNT

SEQ ID NO: 23917 - protein, 85 aa, Candida albicans
VFAVCSVIAFMGEFIVMDLTVAVGIIVIGYFVEQPEDEKEDEEDDDGKLGGKGNGLSILLLAGNFSNTSIPFPFSPPLPPLPDSS

SEQ ID NO: 23918 - protein, 62 aa, Candida albicans
  UNSURE (52): Identity of amino acid sequences at the above locations are unknown.
LLIFVIGNNEQKEKDDDDDNRFEKLSNNLSSSLLLLLLLSSLFWISRIEPSXICSHQHDQYC

SEQ ID NO: 23919 - protein, 438 aa, Candida albicans
  UNSURE (3),(4): Identity of amino acid sequences at the above locations are unknown.
EHXXDGSILEIQNKEDNNNNNNNDDDKLLDNFSNLLSSSSSFSFCSLLPMTNINNHERINSLLQLDSQRLDNHQRINSIQSEPEESIFDKIPQPQEHYNHNHNHNQHNRYCSSCTTATNHSSKMNSPSTTPLTINSHDESGRGGRGGEKGKGIEVFEKFPASSNIDKPLPLPPSLPSSSSSSSFSSSGCSTKYPMTIIPTATVKSMTINSPMNAITEHTAKTYCCNDLSLLSSPSSPSPPTTRSLSASSSSSCCCCCCSSSSCCRYCSSSSNASFFEISMNNIINELDEFEFAIDDDHQHHQQQQIIDKTTTLDKIEVEVYLNKIGTCGVESTDTDTDLIKFQLFKHDILSIDYLKKIISFKMYNDYELLNHFNLLLIKTDKNIFTNDNDEDEDEDENEDENKLILLDDDKILTNYINQLSIIKLNLIRSRAKRETIS

SEQ ID NO: 23920 - protein, 93 aa, Candida albicans
FLSTANMNDNVVILTLRAANHITNAKRADSTTSTEAMPTLSDPNAYTTPSVSVPPNNNNPYIIRQSNPAGTVFIAGAPWSCLMCRRTSYQRRP

SEQ ID NO: 23921 - protein, 67 aa, Candida albicans
CSSLFSSSHGLGIGLSEKCTTLIFLKNSNGSQPLFDFLFMNGKYWGFTTNRSCHSSPNSPVKTPYTR

SEQ ID NO: 23922 - protein, 73 aa, Candida albicans
  UNSURE (11),(13): Identity of amino acid sequences at the above locations are unknown.
ATSDCPAAWSXFXPGQEPGEQFRLKGIQLDLVGPAMQSICTIDFSCSDGIGPHIIQFIIIFWTQLLHNTKPLI

SEQ ID NO: 23923 - protein, 67 aa, Candida albicans
GYRPIARALVLNLKKQFCAVVHHLYYLSTVIDAQTFTVHAHFCRFSNLSHRLGMNEKNFGKGEKKKK

SEQ ID NO: 23924 - protein, 73 aa, Candida albicans
NRRRKREIIVLDIQLVLFLHDYHFLLIVSDLNFNYICFKWDVKVSRLIVFFFGNLSSVLFNRKGMMKERTFQW

SEQ ID NO: 23925 - protein, 62 aa, Candida albicans
VVMNLVTQHMKHPKISFSKRETFFLLNIQKNIISYHEIFIIIYILPLKSSFLHHSFPVKKNR

SEQ ID NO: 23926 - protein, 82 aa, Candida albicans
WKRGKKMAKIFLLTNFVRREKKDGKDFTSCQKKMTKIYQVFLGFFLWVFRAYIGCLGVWEYDGLCLGANGALVAEICAVKGG

SEQ ID NO: 23927 - protein, 94 aa, Candida albicans
GTFSSEFLQTRAQNFPLLGNNLFPKMAKNVVASKKMAKNPHTKLKMTKNVAPPKKDGKKKSHPQERWQKYVAPPKKSRIVKKKMTKKCRKIGQN

SEQ ID NO: 23928 - protein, 65 aa, Candida albicans
LIFNLLQTSRFSRTNFYFKYFYDPLKLIFIIYLRRLTKEGFDYFFNTIIKSNFIVLTRLLLSFLK

SEQ ID NO: 23929 - protein, 78 aa, Candida albicans
CEDKIRLLQLKDDLNKVTFQAYWMTGGDGFEWIEPDQDPADIQWRKHLELYNKPALKQGEFGALGWADDLIQKSTKDV

SEQ ID NO: 23930 - protein, 95 aa, Candida albicans
GCCWNPPIGRSRDKVRAYLKNPQPITNCKPIIEYNAGKLSDAGVNGPHIKPTLGFRGIKEAGFGIYIVVEPDGDDDEGGVGWLVLELVSCFFLYP

SEQ ID NO: 23931 - protein, 505 aa, Candida albicans
KHVKDEVRISTFKAFYNFFKKVIPKDGDNTTEEAIESRVNDMALEIESIIHENFSGKAYPTEARRILFVLKKHFMQEIFDRTITFKDVVHKTPQEINADIAKIEKQNKKNIKNIILTENDNTQIIRRTHKGEIIKENDFERSNQIDESITTRKVDHRHFSPDIVPESNFISHTKSQSKSYNNLNPRFDEDDEEDTATRENEEQEEEEKEEGTKATTEVVESENSETNQLQGENKSTPKSSESLSDVDSPNHNEADDGRLYSFLSGVDNPVTGERKVENKHVWSGRITFPEFATFKAKGEFYTSTDYNDKPMDHLINTTKDILHLPAYTILGRLDRHVADKYLPKVIGSRDFYFVQILNDDANDDQFQKLYQYLLIKNKVGVLSGQPSFVKDSYLIPIDFRDENLPPFLKNSRRDLRIGLFALFVVRKDYQPRARSFETNGNNHHQHAKEKENEEEEEEKGRNQSLSEVGHFTSNGVQSIGNKQETQDHSLDDILRSLDRGGWTND

SEQ ID NO: 23932 - protein, 82 aa, Candida albicans
RQPCLFLLYMILRYKTRKSCFFKSVFLSSGRISSLSASILPYTHYFFAKKFFFRLEEKVYHAKYCTLKESIRATALTYCILL

SEQ ID NO: 23933 - protein, 73 aa, Candida albicans
KSNIIMLNEFKKKKIRLDNNNNNNNQSKRYFIYSLLVFLSLIAAFYCLQIKLSTLIHHHHYCQLRLYLVRKKK

SEQ ID NO: 23934 - protein, 65 aa, Candida albicans
SITSIINYEGLHKFPQIMDVVPVVVYCTSTSNGRMIIRNAFSSLQNYNQSIEEKKNTSMTHIHCI

SEQ ID NO: 23935 - protein, 422 aa, Candida albicans
LLIKLSMFQLLDYLFTTVTFICPGILTIKALDKSVQFNYSSYQFLLNYWLYFIILQYIQQLFTYNSITLSIINYSIFAIKCWLFYGKNNNLKLINKILIDKSITSRNLNTIETKFINPLLNRINPEFVELNFQVYQLGTTYLKPVPTSQEVNIVNFIRGIFDGITAIVAAFSDAVVTVGTGNGGVSGGSATKRRVKGSSSSTATTNNSKSSPSSSSSILRKLRKLRQSSSNQTANGTVSPDTRSRSSSIGNNMKKISNYMVTPNSVSSSNQSVYSSTSSISSSNRSNRSYPTSPVISRATSPPQPPSKPYNRNVSSPPPYDEIINIPEVSLTPPSQTNYRTTTTINGGGNSSNSSRRVSRSSAGSLDLDSTIMAFRQQQQQQQQQQRSVSPTSSSDGMRRSTNSMATLQELLTVRRSHTNDI

SEQ ID NO: 23936 - protein, 166 aa, Candida albicans
NVICGPAGSVVKTKIENDIQQQQQADVLMISFKEMLKSTPPPNKIRDAENQKQSNIKKSDSLRKLKNLTMDIEAFLGNFSLSSSSNKSPPSPKPSSKILKSPSTTQLDTSITTDRSHNNNNDGTITKDKRLSYSKRFVDLPSIRGSPTPSKRSNIEKSKSMKHLRM

SEQ ID NO: 23937 - protein, 490 aa, Candida albicans
VCSIHFQTFSSLLLLLLLLLLVSFEYSPLSYINFSKMENFDQILDRFEKLEVFNYLTSLSAKLSNENETKSIQESDYLIYLSQLNQLVEKANITLDTKKKKLTTETTNPNNESKQTRQAISFNIYRLVSKNYILVLHKIPSKIYDLGNQLVNNLVIDDKGELSPITQVSIIILIDLFENFPNSLGSLINFSITQLYKILKKYPNINSNLIFLLNSITKNATKLDIDDKMQSKLMKIVTKGIINETISYNMEIECTSNVLIKKNYVLCYKNLLLLMVSTNYEMLLAASTSSTSAGAKMKPETIMKQQHDFQMNLLTTNEKIFNYCLSNFSKEIRIAMVELLANLLINFVPTGKFNAIEYLVTLFPLPEYNQWDSNLLMKVGENGEPIVDIRKEKNTLMGHDSESIINSSLELSLFQASVTETIIFYLQLEQFQNLEFLSNNLTFILEVILAKFVELNNMENHFMNQEWNKVLKYWSTVIEYIVQETGSASS

SEQ ID NO: 23938 - protein, 124 aa, Candida albicans
NTLCKRLVPHPHEVLCSFIYGKFVPDSNNEDIFSQDQHQQQQQLVRTQSLNKQRKRESKIFSFKTKQSSKKKNVSNWEIKPYQNPYQAYFLLFIIDMLLPYGVSFESLKKDEKPTNKDLLSKSP

SEQ ID NO: 23939 - protein, 60 aa, Candida albicans
RPMPDCNRKVLVPPNFLTIDNIIKRKRHEERERRRINKQHQGVHTHCLDKKPKANFYCEA

SEQ ID NO: 23940 - protein, 76 aa, Candida albicans
LLQVTFVILNRTIHKALDIYTPNLSFWLSPASSRQILRLVFFFFRSFFYRVYSPFLTVSTKNSLLLARGLVPHIEL

SEQ ID NO: 23941 - protein, 77 aa, Candida albicans
GIFSLPILFEGEAVNLSVEFGSTRFRWSLSFTEYVDASRRCTGRLSIESILFELLMELEIDGALVEGSLNCCCLTGS

SEQ ID NO: 23942 - protein, 67 aa, Candida albicans
  UNSURE (39): Identity of amino acid sequences at the above locations are unknown.
SDPEKIDTKENFESIMEHVNNTLMRSSYSRKQHSGPVAXQDLNIKSLINNQPKLNFSNEWDIVSGML

SEQ ID NO: 23943 - protein, 78 aa, Candida albicans
FSRYHFICCCYNHFIIFLLSLVLFTIIIIIIFIFFNSDKNYLYYTVIYLQSLFCVTDVVDGRTSFEELNLVFRHCMFS

SEQ ID NO: 23944 - protein, 122 aa, Candida albicans
  UNSURE (92): Identity of amino acid sequences at the above locations are unknown.
IIQIHILLCLWKAYFLFVISVQFSLLPLPFPLLSMFSYNLESNNAGYLNHHHSRHHLNSNSNSNNNNNNNNNNSIAISNNNKAHLQEQKQRXSQEPEQNPRNPQGLPELTIHPPTATFSILA

SEQ ID NO: 23945 - protein, 84 aa, Candida albicans
NNKKKISFPKTKENMNLNNLITITPVLKVENLKLRRQLENLSSFICVIDKCVLNKVDKLGAKGADWMYVYSWIRKWVCVYVLVG

SEQ ID NO: 23946 - protein, 71 aa, Candida albicans
ENGCVYMCWWVKCVGMCELVGKLNNGVGVYLYVCTFECCNSVIYIQIIKGNIGYLCTRFKILKSYYYYYRQ

SEQ ID NO: 23947 - protein, 81 aa, Candida albicans
ETDFTCNSSSMKFLWCATLCECLRPKKTSTKFSHTLKFILTYHPPYSLLDYINESTYYIHSKIDNMVLIKKCTILVLCIKY

SEQ ID NO: 23948 - protein, 77 aa, Candida albicans
LPTYWPGTDEFRGGTQDDRRISLFLFFWFIVAGYTAWMMNSGGDGGGGVQSFWNRDEHHVLQFPYNNSKPKHQQQQQ

SEQ ID NO: 23949 - protein, 95 aa, Candida albicans
DTQRVLYLYILKVETQFMMINNTQCDMYQQQKKVCEKRKSHKRVTILKQNKLIPKLMKIFFSFEKKKETRNLRNMWAIFWPAHLIIQNSDTVSIV

SEQ ID NO: 23950 - protein, 75 aa, Candida albicans
VKQIRGENKLNRGRVLVELIKWYGIKILLYTMGTKSATKAILGWFMRIIIIVINIVNQSLAFILSYNFKISIKLD

SEQ ID NO: 23951 - protein, 76 aa, Candida albicans
KNTKFGCRNHEKINSVKYFITKQMIDRVFFVSGGFVFFFLVHAINTPTQFMKEGKKDRKQKTSGCKSHSTNNKIIN

SEQ ID NO: 23952 - protein, 60 aa, Candida albicans
VNLAIFLVTKLALVYFYFALSMSKSMSMSMFMSVAWLIFLVSCMHTLRPRNNVNFHGPNS

SEQ ID NO: 23953 - protein, 84 aa, Candida albicans
LYCLQSIVFLSITPKTKVTTTTTTTTTTASYFKDSKVPKNNYNWKKGFFRSENVLSHFLSQVRLVSLLRVYPFKNFCKILFTLD

SEQ ID NO: 23954 - protein, 60 aa, Candida albicans
HNNKSSSRYYSKSVVFVTTGSERDQLKFGIHKQRKSEINCIFQRSSFLKSSHRLKKKIGL

SEQ ID NO: 23955 - protein, 90 aa, Candida albicans
KKKRATNNSNSESSSKGGGVESGGLSQIKEENGMNRGGGGETITAPTRFIYKGMSKLNQWLKKKEKYNNFLTGEKTKTEIKIKAINLIHS

SEQ ID NO: 23956 - protein, 64 aa, Candida albicans
KKGIRKGEYFWSEKKKIHLLKKGHPRRSAGIAKSQPHARSGTGKKKIIQSNLFLYMINTPTKTT

SEQ ID NO: 23957 - protein, 63 aa, Candida albicans
LKSQFIGVAFGGKARVILSLELIQSFSIEYSEDGSVLMLLAMMAGLVLYKVASEVFLEIKSFR

SEQ ID NO: 23958 - protein, 423 aa, Candida albicans
  UNSURE (402): Identity of amino acid sequences at the above locations are unknown.
NLFYFISFIAFILIHLFITCIDTIMIEYLQLGSTIATISLSIALGTLTIISNQQNVYHLILTISSFIIPLYSIIPIIYSNAITISIQLIFSIFNIISGILFIINVPHKQLYYIPITIIFIVNLVFLIASFIMLLLWMIILKTGLNNTNEESEIYLNDLISKKTSEATLYNTNPAIIANNINTEPSSEYSMENDWINSKDKITLALPPNATPINCDFSYYLGSNANSVRGDLDNARSILMVNLEDQDTKANQQLKRQRWKSIHDEKIMIANLNQNLLPGVLKQNISDDYSNTLTGLENIPSSTNLTTAIVRKIDGTPTNIPEINMEELNNLQQISGYNIIDGSSNLIDGSQLFDKKTSIKSELYQGEYLLPPNEVVENIDQLSDITSKRPSIMNRSFSEPYIXMKSGAPSLYTFICHHGVEDPQ

SEQ ID NO: 23959 - protein, 75 aa, Candida albicans
SDKLSTVSDLMGAKQNKIKQNKAKNKKQKTKKKILLEIKLTTTTTCTGNRLNIYEEEEFCWIQQFFHNRKLKKRN

SEQ ID NO: 23960 - protein, 63 aa, Candida albicans
LGLPLGSYGQHKLKIPAKMNNAPETNMGAEVVKSAYMAIIGANTPIIRLNEAANPIAVPLICE

SEQ ID NO: 23961 - protein, 74 aa, Candida albicans
AYNTPYIIVDMNENIQFQAKFAFEVFAVVDPNKNIPVNINDKNNVPLRPIFNSTNIPPINEPGIPKIDIINVFR

SEQ ID NO: 23962 - protein, 387 aa, Candida albicans
SYSFLHTFFIIMSFKVNWNSLETEPLTNWTKELLTSALNSGKSPNILASNITIKDLNFGKIAPDFEILEIGELDRDRFRGIFKIDYQGDFHLTLHTKVQANPLNIYYHNSLEKEVCNYSQDEFITPNFLLSNEQFAIPLDLKLSDIKINGIGIIVFSKSKRLTLVFRNDPLDSIKVSSTFDTVQVLANFLQKQIENQIRDLFRETLPTLIHQLSLKYVSLDNNINEIKSKLSQQDSVSMTNNELASSLKLFDDEENEFPLIYSSKNLQKNMQLFKSRETFRLSAPKFKNIVQRTRLDKFTKSYPNLLNSLYANNADLQHRFVNNINHGHNNNSNTSSTGIPIELLVSHDDKQHYGKTDNLLKDISSIQANNFYKYSNKDAPDKPERR

SEQ ID NO: 23963 - protein, 444 aa, Candida albicans
WDLFVVHVLRVTLNFTIFTYMRLLDIHTLIINTWELMSIVLFDLNYKISSHKRDPVKHYYQTIIDESIFYWETLLYIPWLFWKVFNPRTGTPVGLSRCREYIPKLNTPKSVALILQINQPMFHSPPEIPQPYLDADRKIRIPEKKEVQYVIAIRNEYFTQCKSHMAAERVRVLREIGRFITWCCLVPTITEISIYEKMGACWDGDSSFIDSIKNSILVELVALANTCDPAELKQFRKVLLQIVVLDKYTKATYVVNDEDSNIPNINTDVTVDDILSAYEDHKKLVVTLCDYRVKTANYEVLASKVVENNLQPDDPIFTEQIPTSPDLVFAPSNEGHQITRLCGYTSIDPNTEAKVKSVLYFSHIKFGYPFFSRAMYHYALEFPFKLLEEVPEPEEEEHPTMIPPSQDIAKIFKKISTSTLKQNAITNRISRVPSPQSLIAKSLA

SEQ ID NO: 23964 - protein, 209 aa, Candida albicans
  UNSURE (138),(201): Identity of amino acid sequences at the above locations are unknown.
SVHVEIEIEMVNFSYQKNKNLELKIYQQTKYILITSINTHPCSYPKLPTDFMIRLCLVRIGNIPSVTPSLHSTPFYTKKLLHPLLIHSSFIRKFSSCRPEFQAVPSLNNDKPLKNTQSSQKNGNNEKDTNSKEEQKVXDDATNTDTLSSGKVLTKSVSKDEIFTENIWEFGILTLTLIQFTNSCVKRNLLPNNQNQLFHNXFTIKLQMN

SEQ ID NO: 23965 - protein, 98 aa, Candida albicans
FPYIYIYNTTTMSTSTQLQTLSKDELIEKVLELEAVLNEFQDSSKELERALEDELLELENTKTQLSEQLDLKKQELAQANTKVINLTSELNNLHESTI

SEQ ID NO: 23966 - protein, 61 aa, Candida albicans
EKTKNQNNTKKKKHKHNNYNNVYSISLDRLAFILRDFPIYIYITPPLCQLQLNYKLFQKMN

SEQ ID NO: 23967 - protein, 106 aa, Candida albicans
KKNTCTCILLRLTTDNMNLIDLPVPIKKSIIKYLPQQALINLSLANFEFYQPCLQQLYKNITIQYNPPLRPNEKDREKDFQDSTRTVIYGFSNPVLHDRGWKITRW

SEQ ID NO: 23968 - protein, 289 aa, Candida albicans
FDCTLNIGIKSFNTRRFKGIKFIHGTNITGKPSPLKNELVSILEMQTNHFDQCMKAVELISSGNGCDMNLGVLKNDAQELPEVFKELTTIYDIILRNEERSKKFLATHMPNIENISDIVKEELAVFRKFKTEEIPRYTFLIAECENKLKECSMPVKSDQSPSQVYTQTLQELTEHYVKFINIYKTKYLAELHHQQFTYPRKFLKKLTEFLNEDIYRIQIEESERRRQWTSRYGEFIPSEFKLPGEHELPVIVQIITEGLEYIQKEDGQEEEPNIGNEKELMDMITGSNK

SEQ ID NO: 23969 - protein, 112 aa, Candida albicans
WWLLEKTYFSSLQTYPSLYALNENKPGVVIQQMHPNWVIGAIFNSGTFNPRSKTVVPSGDGISPTFSYSTTLRYFRTRVAHHCVCTTEVQTVYEQGSPILYRPPGDNDNWLC

SEQ ID NO: 23970 - protein, 140 aa, Candida albicans
  UNSURE (133),(134): Identity of amino acid sequences at the above locations are unknown.
THQFYLIMDAWNSATTFGADGLLGFNSQLPDILNLSDPLLAKIITSKKALQLLESNIVSGVSEDGGESNTNNENKAIIELLMSACDGDVVTLESITRSNPQIVNQLFPSDEIGATALVYASFTTRALASIALXXEGQGGG

SEQ ID NO: 23971 - protein, 600 aa, Candida albicans
  UNSURE (590),(595),(597): Identity of amino acid sequences at the above locations are unknown.
YNMSSLPNPNPNHLTPNFNRRGHRHKRSQAMSGDFDAIGLGLFNSPSHLTTNNTTHVSSFSSSSPPPPPPIFSMLDDLDKHYQFNNTEDFANNPNQGFAFPNITKSSGKLESYSSSAPSSGKFNQHMPSNSLNSPIRLHQKRGFQNNSYHHHHNNNNNNNNNPNQPKFFLTNETTVNKDNVPEALIDLDDIFKANLHIGDNNNTGSNSGGSIPKTTHFHKRTELAPANFYYDDFLGSPFIKENAIEEEEERLEVSFEDNEEEEEDEEEIEDLRLHINDGSDEALPPPSFYQSASANSSNSSLKTKTIEKTLSNSSSSSLFATPRSGAKASRYKNIYDQSKIISNAMKISSENVSGIERTVTPPLNRNNNNNNSNKYLNHSSSLPSLKGKRSFSYVRQLRYGDSKRVASPKTNITIDTPPTPPTATATATATATTVPTSVSAVTVLSSIGLSGSPSSKSPETQFILELPSASTPSTSATTLSTSSNSELKKNRNSPVSVNSEALDSYTTSSSTNSTMDITASPNFTADITANTTTPAIVVTNEQTHLNKDPLYINTNVSSDNTTIEKSASTITASSGNSTPMVESCPAGLXYQTCXVXPSC

SEQ ID NO: 23972 - protein, 64 aa, Candida albicans
VSGDLDDGDPDNPIEERTVTAETDVGTVVAVAVAVAVAVGGVGGVSIVILVLGDATLLLSPYRN

SEQ ID NO: 23973 - protein, 104 aa, Candida albicans
  UNSURE (44),(59): Identity of amino acid sequences at the above locations are unknown.
GIPTIWFNISIDIQCKLHIHKPYLVPTTITTIFDDFNNSIVGGXSNSSKLMPLRFRRRXLRRRRRKHHHYLTGNDNVTSTTTTTNSTSGFDNSSTSGSGIWGPQ

SEQ ID NO: 23974 - protein, 90 aa, Candida albicans
NRSSTTHEPKPELEKTTTTTTTTEKIFYTHNTHTERERESKEEKKKKKENLLLPPHSSKITTLIQKNFFTLLKPTPLRSSDFVLNIIFQY

SEQ ID NO: 23975 - protein, 71 aa, Candida albicans
INIQPVKRANVCATVLNEPSTLGFTNLQMSHKWWFVIVKILLPPLCCRTKGKKKKKVSHSSPRNDQGRTYV

SEQ ID NO: 23976 - protein, 82 aa, Candida albicans
DKIITNKILFNIPNMKIEANVRCVSEIIDIARQLVFDYLRKCIFCFDHLIDKIVNKKIYSVITNDHHILNLIFFSVFLITLE

SEQ ID NO: 23977 - protein, 131 aa, Candida albicans
RTNTQSCSKRKESKYQLPNLLDGGIVGSGVQQLKVKNYNLPTPQSPCPECKKMSPCIHTDGAKVIQPSQRDNNHQQQHQQVHQQTQLRTFSQPNRNFTVNLQHPSDDSLGNEVPLYTTNRENSMPFSDHWS

SEQ ID NO: 23978 - protein, 117 aa, Candida albicans
KVRTERKKKKNIEPFFCFFIFNLVSFLSQQHSSKYSYIHFTMIPTRILLNGAKNVKPKLTYPVELTPLFAAVGVALVSATFFTYRHFTYDKELRLWKNADLSELNKVLDKAVEEEKK

SEQ ID NO: 23979 - protein, 72 aa, Candida albicans
LTDTSTRWLLNKELRALPLLLPITNQPVYTRECDRVYTIHLQSFIICKLISNNDFLKFVYSNESEYSKKKKI

SEQ ID NO: 23980 - protein, 91 aa, Candida albicans
YLGTKSNFTTAYHPQRNGKIEKANGSLKKTQGREKKRKVQKTKIVEKCVEVFISVKCKWTERGGWNVEGEKNKGEQIYTITTTTFSIISTL

SEQ ID NO: 23981 - protein, 140 aa, Candida albicans
KIMSFRTKDKSDDSSIITTNYADNPNLSPIEQKILQQYQLMNNNLIKVSNELELLTNTTDEFGKGKGSSIHLVENLRQLETKLVFVYTFFKGAVYSILNAQDYIAEQETNGLEETNEEEDGNEEDESGNVELLGVSADEN

SEQ ID NO: 23982 - protein, 60 aa, Candida albicans
LRLNKARNYYCKIIVNFLHFFSYLFTYKICIYKLIAIKYIFEVISSHRIKPSINLHTNNT

SEQ ID NO: 23983 - protein, 77 aa, Candida albicans
  UNSURE (66),(67): Identity of amino acid sequences at the above locations are unknown.
LSRNYWDMSMVNTKIEICTLFMKIDDGQLQYGDRKDYIYYPYRNENSEEECADEDDDHHEKKKRPXXHGGKSDDDDE

SEQ ID NO: 23984 - protein, 104 aa, Candida albicans
IPTKILIRSKSFFYFHSVSTNISITSTMKFSLATATLGLIAIAQATLTPYSGYSGYSGGDDDKYRHGKSGIETLRGKFALAVKELLGYEHGKHKDRDLHIVYEN

SEQ ID NO: 23985 - protein, 65 aa, Candida albicans
  UNSURE (6): Identity of amino acid sequences at the above locations are unknown.
TLEYLXGRGYISKSNTNGPTNLTAATTTTTTTTTTDSIVQGATGMTTSAAHEPNKADVLLPPIRH

SEQ ID NO: 23986 - protein, 92 aa, Candida albicans
VKKHGITMRTRELEIGNYEPSPKIEKEGIKKEEEEEEEEEQVVTYSKEFPIDETPSSRFSRGFYYCTSWYYVGDDKNPIITTDWTLEIVAKT

SEQ ID NO: 23987 - protein, 65 aa, Candida albicans
RIIISLFFLTVPLSSNLITLNTVSQNNSDILDSTSEIKSKPKSRRKQRDLQLQVWYQKIDQTSRL

SEQ ID NO: 23988 - protein, 95 aa, Candida albicans
  UNSURE (60),(61),(63),(64),(65): Identity of amino acid sequences at the above locations are unknown.
EGGSGTTAGERQPQEKREGNQEKNEERTGTQTKGKEQERSTGEDRREREDKTWEEGVRTXXDXXXYPPITPSPLCYISEELFFIYSVSTNLCITH

SEQ ID NO: 23989 - protein, 113 aa, Candida albicans
LLSTCFVLNVKKKKKKGVLGLKLDVGEFIMERLLSLSYIIKQEKEFEVWNNKIPRPLFKDYSSFGQKKKKYSYVIRSRDKYKIVFTINIIHNKWYKLSTLYISSTFSPSPPPP

SEQ ID NO: 23990 - protein, 144 aa, Candida albicans
LPSCLENVIYLIYINIDWFSVLSLISFTKPLVIPMFLIIPLIIFSLLLIGQSLFIPTTITTTTTTTTTTTITIEADNSNLITLLTGPQLIENENYIKITKSTDLNQLFRKYPRGEIVNDFNDVDDLNARIFIFDMANLLEDLLE

SEQ ID NO: 23991 - protein, 99 aa, Candida albicans
YLFNPRPTNNSLEYKHLSPETNYTVGRDENTDIKFWSPKVSRELIELITGPNIGNTQPPSSSWSSYSIGSDKTLLINRICCRAQTIINGIIHEPLGIAS

SEQ ID NO: 23992 - protein, 162 aa, Candida albicans
KTFGEIIEHNHQYKIPFYPFLNELIAYLSYDVIEENFQQHIVRKLFYNKNDQDLLLNKLFMNLLEIDPNNDLPKFNVNLLTIDELVELHGTYIDSIINSSLLNEKLKGNETNISYIDQIFNILQTIFNFINTSQEFYSLVVTFGLLVRLDSNANKIELEQDQ

SEQ ID NO: 23993 - protein, 72 aa, Candida albicans
RILVSCYDVYELYRLTVVIFHVRLACKEFNFVDYRTSGDIYDYRPDLCSAQPLNYITYLQTTAGTKIDEHHS

SEQ ID NO: 23994 - protein, 80 aa, Candida albicans
NMYTNLQNKCWQKKKPTVVVIINYRYEKGDAATVEKLLIRKLYTVLLLLLLAAPPDEILKNCSVACVSGGMRNMERSSPG

SEQ ID NO: 23995 - protein, 61 aa, Candida albicans
VHISLLRFIKIIWLNQCKYNIIYIYIFLNILCTFNLNGILMKFKNRIEKKKDKTKQNIKKT

SEQ ID NO: 23996 - protein, 77 aa, Candida albicans
VMNIFFFEVFDNMPFFSCTKLKTRNLTSINYAFNNSDHHHAQTRGGHGPITKRKALLFYNCQNHRCHDCTYMYLFYV

SEQ ID NO: 23997 - protein, 74 aa, Candida albicans
NKEQKEIRNNKALIQLHLKQNWYEFCFFHYSVHFLTLFISISSHISCSEQFQIGRHSYTYFTYTLLSSLFNQNL

SEQ ID NO: 23998 - protein, 123 aa, Candida albicans
SITMTIETIDIDLFLGIAKLHPNVIAQIFGYLPKCLLPHLLYFPPIREIAASVILSDVEITEDVERHMWFDGFRLCQCLRFNIKLDNLKQGIAQWNIYPHTFHMEHVEQFERVLDTLSSHSGR

SEQ ID NO: 23999 - protein, 81 aa, Candida albicans
ADPNTVEIALKYSFLSLTVLLSSVHKLKRRSMETHIFQTKCSCWVFKLIITSSRSTIISSKVTKPLIQSLSFFFFLILILI

SEQ ID NO: 24000 - protein, 62 aa, Candida albicans
AELDPEIDILNTEQENWWLNLECKKVPNLGVNLTKIQFFSNYHDYPLNSDLSSPCLTNRGRL

SEQ ID NO: 24001 - protein, 66 aa, Candida albicans
FSVLVPVLNMSSNIRRYQNNIIFQLIHNHRFLLSISSKLKGGGIENELEKESDDSKKKISQIQILR

SEQ ID NO: 24002 - protein, 75 aa, Candida albicans
THNDFNRSIQIIFYVQDGLELFKVSIWTANPLFFVLRDDLYILAPCRAPTEDMSSIPTSNHYYALDNRSNILQSY

SEQ ID NO: 24003 - protein, 80 aa, Candida albicans
STGRDIIALFRSLAEFTANIITMTVSKYVYINQKGIKQLTSQMGFGVLYRKKKIERKISHQNCFPFFVLFATKYFIWSCN

SEQ ID NO: 24004 - protein, 61 aa, Candida albicans
ITTIKHQHKSMPLAPVMYYKALIRKICIIHYTIRSQYKFLIYAIESHTLLSNHSSEHQKGN

SEQ ID NO: 24005 - protein, 60 aa, Candida albicans
YPYIHTCALDYIKYIPSRRMPYSNKRTFDANFFNSLDDEQATTSKQGTNPSITVVVVVTY

SEQ ID NO: 24006 - protein, 125 aa, Candida albicans
AQKKKKKKNSKANMIPIQPLMDFDPLSLYTPSPLQNEEVLIPIYQGLSEIKENENLSETLHDDSHLEPVHILYLPLLQLKPPYEVLVSILKLLSPEETFNFGGCLEHFENTAIDSDTIFQGEGCN

SEQ ID NO: 24007 - protein, 476 aa, Candida albicans
SDSDLFPAMPQFTPITPGIFNYNTYMATQSVQPNNKFEPLLSTPNSVNGVSNSPVQFSPPTQQYPPSSSSSSSAPASTVDSTVGEKTGATIGLGVSIEPAVKHKKQPSPHQQAALHFQQQLNNEAAAKTHKHSGGSSTTKTRTQLSPEMQKLIEQQREKQQQQLLLLQKGEIPKPPELKPKRKSSCRPHKQKRRYIPEEEQYYQHQYQHQHRRIASLPLQTIPGDSPTTIEVYSPQLEVCNDNSFGCNTTSFITGGNITAEELLSNDPFEVLDDHRNNIFPEFVDLDFEDIGGVDFENSIESVDVLSLNKNSSSTNVSVQRPTLKKKKSITPGPAKIAKTLKKSSSFSNGSGISGSSSPTFIINPKFQWTKSQTTEQQQRLLKKKVPYQHAHSLPDLSIQEMPVFTLSNHYLFVYENADSILQDENIEENSQTSPRKQQQLQQLQEQQSHKEVELLQNLESGLVEFKLELNKNKMS

SEQ ID NO: 24008 - protein, 240 aa, Candida albicans
  UNSURE (207),(230): Identity of amino acid sequences at the above locations are unknown.
IYTNKIDIMAEVLSLVDLEIPQVTDKYYKFDTFKHLICHLFKKTSTETDSNVPIVIIFPTNNDIPSRKTRSTTTTTTTTTNTSKLDNLPFSDKSLLIQFFFTHLNILMIQGENSDEGKLYQEISSAKELLTNRISRVGNWTGTTHFRYCRHENDCGLLNQHSKIAGIIPTMTYILNCNATRSEIATNQLIYLYRLMIEEINFIELLXDASTTRLSQLCYAVGHWSFLLIXYQMNNWFMVF

SEQ ID NO: 24009 - protein, 78 aa, Candida albicans
FTLLVYTLDKFVVFVLLVLFILYSLNLLMGVELSGKEEKKIEGEKRNVFFNFFFFLQLFEVVESSPSFVSSVDYVKIC

SEQ ID NO: 24010 - protein, 61 aa, Candida albicans
WIGDKSVYIFTSRRNVSYGFICLTLFNPLFQLFRFVSVYKQFNLTNAKLIIKQDKEEKISV

SEQ ID NO: 24011 - protein, 107 aa, Candida albicans
ISNFNLNLNFFGRVSFYTIKLISNTTTHTHTHTHTQTYIHIMQFTTNLLLSSLLLATLFLSDFVNGSKNYRHIKRNVVTVVNGPIDRTDTYDGPIPTGYYYKLPFII

SEQ ID NO: 24012 - protein, 79 aa, Candida albicans
GFEIDVEGCERGAKRNDQVKACSSVNSWGVCKKMFTVLIYATSQLGLDYSYNKISVKSSYEISTKSKPGKKKNTFSSKN

SEQ ID NO: 24013 - protein, 174 aa, Candida albicans
FKIVLMFVYWINNLCEIIQCICWRRRRQGRTFFPSYFFFSLSLFFQSHCLSVKGWLFCAEPCGLVNARHRVIFGETKRILKNRGLNSTTDWLDDKMQSVFIRTFATSRIEFQRYQPRFVNTIKETVKSAQEKSYSITRPLGLSKPVLLNHKLSDTYSLSNIYEELFGQKSKERR

SEQ ID NO: 24014 - protein, 62 aa, Candida albicans
KTIICILGYATFVIGEAKDYAACAPQGIIQIMEEQFFSQKWEESTQCQDIDLMYGCLTSWCT

SEQ ID NO: 24015 - protein, 308 aa, Candida albicans
  UNSURE (264),(298): Identity of amino acid sequences at the above locations are unknown.
DIIDLQMKNQRPKPRYFMQDDDQAIHREPPRHLQLRVRSFTEPTPHCTADSTDRLVQTAQEPSFIEDSEDEIPVILSSISTSMPRFSSIYNSFHSSLETSHLLVNQHCDEEFQMHNENFNPQDFAVMSQLSYRHECNMSQPIMISNDDSDVILINLTIDQDEHEHEEYDYEGERNISIESDSTEEFDKGNILLGLESAKILAPKVEVNFSQEPNDDEILECSTQYGEEDDAIVVESDNMNVTLEVEGQQSEKLAEGERAKVDPXIIEDSEQSKISSNYLHETENEEILVESFPGENKXCPRDPLGNRG

SEQ ID NO: 24016 - protein, 67 aa, Candida albicans
DNHLIARVYISLFQFNFHQTFTTKNSRTVPSHNFLFTVLLRQIQPQVRYYRSTNEKPATETTLFHAR

SEQ ID NO: 24017 - protein, 61 aa, Candida albicans
KFINSEALQKLCYIDSICTCYNPTETNVNSVFIINKGTNKMLLVSLYGLLSRTNTSTKKKY

SEQ ID NO: 24018 - protein, 60 aa, Candida albicans
VRVLSSPVVKNDMCKCMNVNNSSMSNATQAIRPHRLLQLPLFFFSIISLVNPPIPAILAS

SEQ ID NO: 24019 - protein, 60 aa, Candida albicans
AKSIYIHISIHIWIMRNLELICKLRTKIKNNSGAVTTPSIDQKTHDYPTWLRSTHPRCRF

SEQ ID NO: 24020 - protein, 136 aa, Candida albicans
LLQEMEKAEDAHENYEFDYFLIISRVYQLVDPVEREDEDHEKESNRKKKNKNKKKKLANNEPKPIEMDYFHLEDQILESNTQFKGIFEYNNENKQETDSRRVFTEYGIDPKLSLILIDKDNLAKSVIEMEQQFPPP

SEQ ID NO: 24021 - protein, 63 aa, Candida albicans
EDSCNMVASDFFCPFQRLSIMNLNLLLITIGYYYFYKSIYLTKIYVFVSGFGFDYEKHYSSYC

SEQ ID NO: 24022 - protein, 131 aa, Candida albicans
NSKHSSNSATISWCGNGKLMDFNGLNIIQYLNFGPAYLISTNTHPNSSENNVTTNPIQALQNYKSCKNLTIDGLKLLYYTKCYNIKQCQFIRYHLYQLYIKNFGSLGQNVNDKNIESYYKHLDQLFYKVWK

SEQ ID NO: 24023 - protein, 191 aa, Candida albicans
PSLQMILPATTATSFSESDHSSYLSKRFNTGSTANSKFIVLGAMLGSIVGFLTVYYILLEIAMPLCKLCELKTDKSCEHTFINRQFDEVVEETLSRPHSQMNTSNINSTAHSSSAGPNNSQQQEHKELTPVVPVAKNQSEYHDDLVPPYTKATTEEQYMGSFDTNGEFHPTKNPNTLTTPPPAHLRNTNDV

SEQ ID NO: 24024 - protein, 95 aa, Candida albicans
PKAFINAKANPLPGIAYPTINSTNTLRPNPNIVLDCTVVNGIKNTKLIAKAKKIPQTGVSAGYNLTHNIANTNEITRMIRYAHSGTSGYALIITL

SEQ ID NO: 24025 - protein, 260 aa, Candida albicans
LVKLISPIIKYLYGKVLYLQKINSTNGWFKYLKLKILIQWKYTIACFKNDYSQTLSSNNNTNTNTITNSFQNIIIKSLTTLIWPFLSSKLNELFIYPIFLLNNPKSWLANNNINLNIGVFGLSMDKKILIGNLLGLIMISIIKELINLYLTKLKVYQMSKIETLNSQDSQILKDVTSTIFHPENISISTNNNNNNNNNNNADNDIFPDLNNITTTGDDNDDEDELDLVTDDSDESFTMHRLVELGLIDESDFNIPGGFNF

SEQ ID NO: 24026 - protein, 84 aa, Candida albicans
TFNFVKYKFINSLIIEIIINPNKLPIKIFLSIDKPKTPMLRLILLFASQDFGLFSKKIGYMNNSFNFELKNGQIKVVKLFIIIF

SEQ ID NO: 24027 - protein, 151 aa, Candida albicans
PTVETTTESVPVNQHVEKENEKVEVPPPLEQPSSEKREKEVNGSIKKPLENESKVDIPQFSSNITAQNEEAKSGEETKKDTTKTSPAKQGEVKEVIPSSTETVSKPDVEKDNKEKDKDEDEVMADEDDVKKDENPEPPMRKIEEDENYDDE

SEQ ID NO: 24028 - protein, 61 aa, Candida albicans
NKTRNKIKIKKKSKEEIVMNIYVNFKIRYNHNEEGLLNLSHSFIFLKLDFPLYVQFVFDHE

SEQ ID NO: 24029 - protein, 60 aa, Candida albicans
YYTPAFIPLILCVAKTSQKRLLKAGLNGLRVNQSQMESLYFLLGFLESSWCLMCLTNDCG

SEQ ID NO: 24030 - protein, 67 aa, Candida albicans
VQFISNSGFQLTIYRRFTSSIPELNQILFLLLFSSIVSGVGNYIMYTWILHRLKKNDKTTILNFCIS

SEQ ID NO: 24031 - protein, 81 aa, Candida albicans
YYFLNHITDEMSIIEIYFNWNYPLTNQETTLYIPQKVIRSIVLCRNKQLVLYIYYQLNIINQSSNIKGYVFFINEYNDKLI

SEQ ID NO: 24032 - protein, 64 aa, Candida albicans
RHLYHNNKKKSFLWRISSHMEGKTNCKPPENLFYSNFRKDDRRVGSKCQVLVVFVQIFAKMIAG

SEQ ID NO: 24033 - protein, 62 aa, Candida albicans
SLPGYGLCENRNEKYGKFTCVNTTRLSSLRKFQLKPSKAYGLNPTRRSSLRKFEQKQLKLDI

SEQ ID NO: 24034 - protein, 310 aa, Candida albicans
ISFTLPPSQLLLFKMITAILLLIAKQVTGVELHHHHKHASNITTLSITPTLVARDATEDAMPTLSTGEPTLLITHIPVLKNPYIYSSNLPSNLVFIVIGAILGAILLLIKLYRINAHFKYNRTAMNEKETYYTNLTEILNQKGTPYSRNSSILDLSNSNNNTTDLSSSSTSSNQGRSYRDSVLGNNKPMMTNKPSRNSMFISPTMDLKTFELPLYQKQHSTSLASLILRYNNDSSTIVSTAFDEKSRITTTSTTVDGNESSINGSTINGSYLENGKLAPPPPKRVVRAPSLYLEDLLNDKSKDDKEEEGV

SEQ ID NO: 24035 - protein, 253 aa, Candida albicans
HFHLYIHFNMIRNSIKSIKLNSIVASRTTTTTRLVHSSSRILAKGDSSTIDSYRLPSQTSINEWEFKYDFIPKTSEPKVPPLTKEAVKQDIAHEKAKSVERELFAKESNSSIKVEANDAKVVHGGESVAAEPVLKEDTGSAPIDVSTPKSNINVSSSTTSTKPKKSANHDKYVQSSINPNINSGNVVNLSEGEVDHKTESVDKQSPVVEDIEHDNLTYQGEIKKESSGAGLGIFALLGLGGAGYYYYSSTSKK

SEQ ID NO: 24036 - protein, 77 aa, Candida albicans
IVVVRISPTINAWLRNQKKISSKLLQSDQKCFETCINSINADKHDKLFTSNIMTSPIPLLLLYHLLIYHSINLQDIN

SEQ ID NO: 24037 - protein, 60 aa, Candida albicans
LEPWDVGFISQSVLTVAERIDWCSYSPNIAAIHKVVVKKKIDLKKRGNLTTSAIHLKRNK

SEQ ID NO: 24038 - protein, 103 aa, Candida albicans
DFLHQAESNCQPSIWFHSKHQYGLELCVYIGVYRVIKFVLKHNFVTKSPSIVVLFFFSFLFFYNTKKKLERKYKTDTTLYNTTFADNAVYIHMQKTFKKYTSK

SEQ ID NO: 24039 - protein, 70 aa, Candida albicans
IKLSSIKFLIKFYNFNYFLIRIRLLFFYLTRVKIPTQESYNFTLFVVSSLLSIIATFISSFNKPQPSFVI

SEQ ID NO: 24040 - protein, 82 aa, Candida albicans
NTCIIVTQFNLNSLNNRVKEKKKEFVFYPCEIFEILNFFSVLYLETRKSDLYFIIILFSFVVVPIFITKYPYYLNNQDILSN

SEQ ID NO: 24041 - protein, 380 aa, Candida albicans
KVRSESIRVIHSFLEAKPIRELKKCVLFPRVLGKTDDLDDETVRNTKLNAELFHTSNDSVELYRQENNSSDLLGRLYYDDYDSDSMTSPSISGVSSPMPLSPIMSPSESSDQLSVKSRPPFLRMKSMERGISFDTSPHGHQKSYTLKAKHPLFKFRRTNKTFLVGYNDDLESTKAIEWLFDEMIINGDTIVVLQVLDEKQHVSIDKSKVQKNLAKIEQINHHFKKVCIIYEAAIGKAKKAIRSAIDEYRPSMMAIGTHHYDGKEHHRSFTKSSLSKHILECSLVPIILVKPSYRYVEFLREEVDGPQYFENWIKNIDHIDNRVIRKKVPLISPSVSRNSSYTNLVNEDRGRGGGVHDQILNESRSRSTSKNRVFARFFKK

SEQ ID NO: 24042 - protein, 115 aa, Candida albicans
PTLTLLLLKKSITFLAALVSLVAVDARFDVDDDEEEEAAGADEDDEDVVDFDVVEPFEFVCLVSFLIILVSFEGSNTFLVVFILVGFNTVVLFSELEGTLLVASETFEFDELYEL

SEQ ID NO: 24043 - protein, 234 aa, Candida albicans
DDKSNNNVLSMIFNNYSLSNIKLFYQCLVFQGIFLVLLKNALNGNNNYPNNNPSTSLPKFKINLEKIYQFLLHQYQTTLNKILNHEVCRELQENITLFKLIANLSIEFNQYLINPITNNNPKDKDLDLTELIYDLKSKISSSNWDLLLNYFFGSKDNFARYIEKIWDLFQYLKIDPTTTTTTSTVSTTDIPITSKIYLNDQLIDDVMGKFSGFKFDENVVNEYFKHCVEPNIFE

SEQ ID NO: 24044 - protein, 96 aa, Candida albicans
KYKFLSCRLTFSLYWVYLLFLLIPVLLYCPFFLDYLINVPTKMPVQQSPSNTTPSQQEQFILIVAAIILPPLAIFLSKKYSHIVMSNAIHFVNTIE

SEQ ID NO: 24045 - protein, 200 aa, Candida albicans
CGTFQRPWAENNDLVYFNQVFDMATKQTSDPDPDSYVENSNKTITLITLDKPPNNDTNAVDAQFKKKKGKLKPKWELNAGVYLEKKVNKKLLKKSKKKNSKKFGILTKDNGDAERILIPAELMVSRATPGTHNLFSQNSSNYPFQLTKINVTSIRKAPVLSTSIAHEVSDINHGIVEFSIASKVFDKFWNQIFWAFLYIL

SEQ ID NO: 24046 - protein, 79 aa, Candida albicans
IALAVRAWYSKETVEQAFWLVRLLNNPKKRDNIIELVLIRKEDKPNTMKKSNGKKEIYTFKLCNFSSSILYSYIFFLPH

SEQ ID NO: 24047 - protein, 191 aa, Candida albicans
IDKNSAQYTTYMMKKKISAKKKNQQQQQLHQPTMSEVTEEERTRYEEEEDVRDSPSDSSEESEDDEEEIQKVREGFIVDDEEDEVQTKKRKSHKRKRDKERPHYDDALDDDDLELLLENSGLKRGSLSSGKFKRLKRKQIEDDEDEIESQDHQGEQQLRDIFSDDEEVEEEAAPRIMDEFDGFYLHHGAGR

SEQ ID NO: 24048 - protein, 62 aa, Candida albicans
YSCRNYVILDNGEQIKKCWCSPRFAQQIPFFFFNVKAREIEREEERGAKTPTREKEFQDNTK

SEQ ID NO: 24049 - protein, 175 aa, Candida albicans
FIELLIMNSIKSLVNSFDKFYPNSTFDDSVILQINDIPEEEEEEGEDDRQKTLVPIKLQTDKSLTDSKDSLSEKHTQQVEIEEEDNNEEEEEEEEEEEVDEEEEEEAEDDDEDSINLIEEKKKLDIDSAKSHHDEQFRLQTHQDQQSILFFIIIFILRCVIFLPNNLIIKPILYA

SEQ ID NO: 24050 - protein, 62 aa, Candida albicans
IIKTVIPLNTTTCFILVFVFYGDGRWGGGGNINAIGQKKKIKISLSIHSPFKLLIKYSYTLL

SEQ ID NO: 24051 - protein, 91 aa, Candida albicans
SPNLRWTVIPEGKIKESKAKQSKAIIQIFFKFFFFFYTKRHNDDAHIHYMIIKSSLVSVYHLTQLETTIPKNLQVFQSKSDLANIDKEVKG

SEQ ID NO: 24052 - protein, 90 aa, Candida albicans
HKEMFEQKERKRECETKLKTKIKNGKKSLAQASNNNSKIFICLLFSSFILFCFVFNRLCTFAFEVKKIFYLSQKSLGDLLHSWRNVNTIL

SEQ ID NO: 24053 - protein, 62 aa, Candida albicans
MDSSRWTSINERERDGLKTVGIYKPIDNPNYNNLGISIYMYIYMYGCTLFNCIYLQCISFIF

SEQ ID NO: 24054 - protein, 112 aa, Candida albicans
SNALNKTSTFRTNFPVTTIPLNLLPVQAHNNISDIHLAVISSYPESVTQHFNTTCSICCSIDMSMAESTEMWLSLSSFTNFNPLRTSSGKSNNFWRPTESGVIQTFQNLCTI

SEQ ID NO: 24055 - protein, 67 aa, Candida albicans
IYIHIYMRVFFFFARIKDIERNTSKHVEFLAIQPRKYIKQYNTQRHMTSDIFFLQQNEIRAIALTCD

SEQ ID NO: 24056 - protein, 69 aa, Candida albicans
WEGGGGVRQRWFWIGSRSSMTISRRFTSLSDIPAKDNNMKNHLICSPQHYNRNNIYSPFFVFTTAWKIR

SEQ ID NO: 24057 - protein, 101 aa, Candida albicans
LFAAIVLWTIYYISKWNNNDSYSFCDNEIILNNKPASQIFPILCFHVTYLLLFSRKIHVMLSFASKVHKRDEVASNCINSCHFDDAVADYLLPLLNAYGEL

SEQ ID NO: 24058 - protein, 79 aa, Candida albicans
INFDNFCLFLFNLSFHFILSVLLQIFFYPFSYTFYFILLLGFYFLITFESYNKTSSILTVHCRCISSNIRLNFYFIFKR

SEQ ID NO: 24059 - protein, 439 aa, Candida albicans
SFINTYMSNTANKPNYRFNNQDQIQSKDNKENGRVARTMTNHHPYLLKPSQQRDKTSLIPKIPRNKHIRQQQSPPQTAQSPHKTSYQDDLFSFINFNEFEFSQRGTLLKSKTRTPNQFFLTKNPNQNNPLLESNSKIQDNDDNSGSDTINSTTNNTTNNTNTNNNITTTITTNDCSIFSTLENNKNRNDTTVATSTIYNISNNELVDTLSIVSSNLIVDDKYRLNIISDDASYQPSHVNNNNNIHNGTITTTTTTTTTTSIVEATGCSSSIITPTQSTKVVVGKKLIDRLHHSLIDYTSDHVLIEQGSIDCSIESGEKDYNCKFNTHHHYQGEEEERFGDNKYYQNIIHHNGNQCDNVSPSPSLSPPSSSYMQDQPSLDLLILSPQKSPTTNQHHKKYKRKLLKPNTTTTTATGTPKISRLSLLDSLHPMDSYTYIIHP

SEQ ID NO: 24060 - protein, 93 aa, Candida albicans
NPTKAVTNNPTHLTEHTHPIEIPVKIYHLISNFVSGVLELLPTRAMAKVCTLTKQYIVKTVKNSSIESNKINLDNVNDNCSKITMKAINQQVN

SEQ ID NO: 24061 - protein, 79 aa, Candida albicans
ASTILVMTIGTTAKGKDKRLNNDNAGNTKSVDKLLFEVHTNTANVEQLTKNGAKFHVKLDDAMKIPIFFKFFNSFSFLT

SEQ ID NO: 24062 - protein, 63 aa, Candida albicans
  UNSURE (4): Identity of amino acid sequences at the above locations are unknown.
ARDXPALWARYRHLPLFSLSSSNEFTTITNNHNNNTSSQYQGLNKWLSCNTQRRWLGSIIFYL

SEQ ID NO: 24063 - protein, 227 aa, Candida albicans
NQKSIIDTIIPIMSTEVNQTVSKVKGAIEDESITEQESGFRYAAYANRLRTILLASHRYVAYTSDIGESFRPVAHPYLVKSGYAVSWLYILGDVSYASWITKMKAEGRYEPGLKPWDKAPAPNEIAAKTFTSTHSLVDSDWRWSALKRGIFQSIASMGLPAFTIHSSVRYSSYLFKNSKVPVLKTYGPVAIGLGIVPVLPYIFDEPVEHAVDWVFEQGEDIYRQKFK

SEQ ID NO: 24064 - protein, 60 aa, Candida albicans
LTSGFSTMLPKKKKECYRKIQHMVKLLPNERHAFLPQQKNIIILRPHNSNRELKKRKHQK

SEQ ID NO: 24065 - protein, 74 aa, Candida albicans
NIADPISPNSSDVDGGSPMKSPIVNGESGLESPSLSNADYSVASFSPRFHSSFPQPPYLPGNSMMTNSNVSLVS

SEQ ID NO: 24066 - protein, 242 aa, Candida albicans
RHKRGSGEWLSVKTNAEDHELVDRLLLGCYSVLGIDVSTLIQDDYSKYPNFKIELDKRNPCIVNGKIVVNHLQKSQESDDKSSQEQETSVPTDSDNSLDLQVDSNIQKEQDVSESNEYDQSNIPELSADSSTSILDINTVDTVNKNIATEISSKSNLPEVEQFCKVNDIIVTDTECAKDESKVQPTEEFESVIQRNEGGLGLTVKLTPVKNRSAIETVSPKQEFIVKIVKKKPEEQVQESSS

SEQ ID NO: 24067 - protein, 223 aa, Candida albicans
  UNSURE (223): Identity of amino acid sequences at the above locations are unknown.
LHIITTILFTIMPVQQRDLFSDINNIISAGVGVANTVASVGEHVFVTLTSDAAGNWHKATSGVVVEFNTLTSKGAQEFHVVTSLADGKFSTVTKGVVSNWGEFTSEIESKKDSLTAAAAAATESAASTTGTETVSTDSASGSASGSGSASAASNGSSSTTAASSSTRSGSDSSSSTATSSRSSSSSSSTASGNAAPAVYQPGSWKKSAVVGGLIGLSFILSLX

SEQ ID NO: 24068 - protein, 70 aa, Candida albicans
NFHLSKIRNRKKTTAAAANRQIVVLSLREVLLLIKYILFIYFLRGGQICYILRLHDKKKFNGGGGGGLVD

SEQ ID NO: 24069 - protein, 69 aa, Candida albicans
WWWWWWVGRLSGYQWGEKVKKKKDKAPKKGVDKLNISQNKRLASTVVVVIVVIVVVIVAIEISATTKFH

SEQ ID NO: 24070 - protein, 193 aa, Candida albicans
NILTPSQFQQCVHFYEADQKLDHAERVALATQLQTLAMKTSLAGYTTGMLGFFAPTFYYRAVGRVPTPLFLVQRPFLSLVLGFGTLLAGNNLTAKYLYEKNRKQGFANQNITDVWKTMDFPYLNFFTLYYSRTSMFPNFIMRDPRTCSYQLLKQENLHFTQAIKLGHLDSEGKEHVLSVWDKVRLNHGGGVSK

SEQ ID NO: 24071 - protein, 223 aa, Candida albicans
FAKMKKKNFAPLSFLWLIMSDNILRDRLGPEKFEKAVEFYDADQKLTPEDRVQIRDDLKLVLVGDNLASYGSGLIGFLMPTIYMRFFKKGLVNAKSFFQKPLLSGAIGVANMMVTHRIYSKKLFDEKVSLGLPERQLNVWKAMEQRLLGVYMFYYAKTAQDPKFKLEDPREYTEENRLKVRFDPEKYKEGHPHDELSTWDRIRLSNGYDITEEKSAWDEIRSK

SEQ ID NO: 24072 - protein, 192 aa, Candida albicans
LKKSRPGTRLGVNRFIKCEKKKFSTKKQHVDTHHQAVMDAFSDSGELYTIRNQFYTNQHNKVKAYSLDEFSPENQLKVLEFQIRSTIALEQDASKMIEDGKTRFPENEPLFQLLSAWNDLKDFGVDDSTYFEDVKKASFELQAVLTALYLVKFDKDIDQAITFLSDYIDNVNSLAKYAECHVLNCDRRKGNM

SEQ ID NO: 24073 - protein, 77 aa, Candida albicans
SMNKRVERNVKISLFVDSIPNLLSPKSLLPPRKKERTNKKQRARNHQVVYSSDYHRLNTATRLEQLQSLNVQQYNVY

SEQ ID NO: 24074 - protein, 308 aa, Candida albicans
PITDAIHIISIVIYGALEIAMVSLSNLLVCLGLVVVPTTLAFSDTAPIIIHSNNQDALESNHKYITKFVDVKSKVDEIIKESCSDKNSKLFIYQIEDLSIESDYSWLLNKGSYPNVLYHEKNEANYDFNGKCEEKESGTVQFSVLKTGSLQEIYEKHKENKNEVFIIQVLPKFTSGHSLKAIKEKMYNLYNDEDIVISSKRDKQSDNENDAEIEQEIERDFEVAESLASEESDPVSIFDTDKQNKNGTVVKHDNLFTKYQFFTSGIWSGIIISGFLLVILYNALSWLSSLEITYASFEKQIDFDKKNE

SEQ ID NO: 24075 - protein, 127 aa, Candida albicans
NYNPIVNRAQVMSDENTKHKFLNVSQPSNLLGGSSSSNSLRRPLNDNTVSVSNKMRKTTSQIPVAKDTVPTLTISESNRLRQLVNEKKIDLEQLKLNATTLRNELEKQTYEKLYYSIQLPKSREDFK

SEQ ID NO: 24076 - protein, 93 aa, Candida albicans
LTPYFARTKYRMVKKTNIKAIKTPTANARKNSTVEGVEPMVVFCDPKSLAVDVGIEEYVLCDMVSVACSNDEDVGIVVDIDNARFWFRCNEKK

SEQ ID NO: 24077 - protein, 60 aa, Candida albicans
EYPPRKFKLKLVYPQKAKIGQEKKKIEGQEISLGGGRKVQSFSFLKLINKNKNISHPFDC

SEQ ID NO: 24078 - protein, 323 aa, Candida albicans
DNYILFFFSKQGEIILVHFFSLHRNQNLALSMSTTIPTSSSLLQATETMSQSTYSSIPTSTANDFGSQNTTIGSTPSTVLFFLALAVGVLIALIFVFFTIRYFVRAKYGVNYVGLTRRGLYGYNHHVNGNNNGNQPPSSNIVNEHTFAQIFTTTEVQDQLDYIRQHHYLRGEIIDRRLNQDDEDSSNDAARQRQQQRRRRRQRRRRRGGRFARMKKLTAEEVELLFPKKTYHQWLNGGKEEDVENREDLFCEVKEEEQHHHEEDIQNENNGQSSSDDNNNNNNIGGTVVDDENHNCSSSQTEDNESTNTFFRSSLRLARPTRF

SEQ ID NO: 24079 - protein, 61 aa, Candida albicans
PPTLYHFANSSMRNYHALIICFLVVMDLIHSRTSATRFNTNKLFQTLTLKFKTHQTLHQNK

SEQ ID NO: 24080 - protein, 162 aa, Candida albicans
PNMKSISFILFTFLLFVAPILGKIQNVYLYVRSQNQTVNGNGLYSVKERPGINYFFLGPPNHAQKLIYDDQNYYIYQQVDPHTRYYFGIQRNILQLSKGNPQRVVMRRNGELNFRGDDKLYAVKNIGDPINYSKDHYAVKYYANKNNVPKHAPKVTVYAKKA

SEQ ID NO: 24081 - protein, 123 aa, Candida albicans
LYATSTNQEINEHKISYRTGKFPSYDLYIDDQTSYYQYDDFNKVIFYDNKVRFYLTVINNILQLSPNTPLLIDIQSDGKILDDTYAVETSSIAQTSAKKNYNIWYGTDPPIDAIPLSIHASYL

SEQ ID NO: 24082 - protein, 200 aa, Candida albicans
LLKSFDFIFTKFATNSIYAKPNSYFFKSTLGMQIQYIQHTFLSILIIISHCFCELISISLYAKSDNSSINGLGLFSLHEGEGYNYLFLGDPKNAQKLVYDTKMYHVFFYYVYLFPYYLTLVNNFLQLSSVHYPFKIKIKKNGDLTFTYSDRLYAMKNVDDPHNYSNEYYAIYYYPKSSIVPSQAMKVTITTSMPANQTYS

SEQ ID NO: 24083 - protein, 62 aa, Candida albicans
LFRLVIFSKIIVLLEYVTFSSVRYALWFMHSILGNYSNMYSKAILKYCIQKAMIYTCIPKQT

SEQ ID NO: 24084 - protein, 97 aa, Candida albicans
VLRETILEVSAQSKTKFFFFYNLSYSPIVLLLPWQTEQKKNSEPILEFSRVFTLYYNYSYTSVTINLTEYINTANHGRKRSRSVVGTDKKLHFIIRI

SEQ ID NO: 24085 - protein, 76 aa, Candida albicans
  UNSURE (42): Identity of amino acid sequences at the above locations are unknown.
PLGLTIQFHNEHLKGPLGYKLKIWPTSNSIQIMLISRDWFQXQFPFSPLFTTQIPSVLYPQSLDSSLSSPNIFLLS

SEQ ID NO: 24086 - protein, 75 aa, Candida albicans
KQQGLFKREKKICFVVQEIFFFFFHHFIYWCWCYLRVVAVVPINRKSIQTLHNNTTTKDYFNNLSYILIDYSIYK

SEQ ID NO: 24087 - protein, 236 aa, Candida albicans
KRMLAQPELEKLKEKKLNEKIQFIESTKTALVNEFGFDSEPSSKQLEDASERLYNIYQLRASGQLLSEARIQTTFNTLYDLKLQAQKNNIDSLPNLLNEAKEFITRIDSIVGIEPTGELFKNLTKEEQLNLQKEISSELDTLYQTKALEKDYRIEAKKLINTPGVFEPLQREELMAKYLPQVLPMDYPGSVIEISDSDSKNKNKKLSENIVIQRIFDETTRKVKLIGRPKEAFASA

SEQ ID NO: 24088 - protein, 478 aa, Candida albicans
ADLLARGGHSSDVGLADRHLNVANDHLHLRRESFSHETKPKIKKGRPRKKPAFHLQLDNVKICVPTITSSQSDSGTDYWNRTPSGHVRRRLASSTMATLVNGSNSKSNESDLKIADKDLSFADRNFAIPTFNLTPSMDPPGNPNGYFELNTTPGVNGNLETSGGFFSPAINDNSVNNFNKTFEDYLQEAEKLSDHKGTGDNNNNGNIASINQSNIVDLQQGTLETNFTELDIPQSQSMFTPLNFDSSVGDDFLSPENGTQFDRGRLYSNEITLQYLTVGSGDEEDDQGLDFRLQLPVLQKTVSGQSGHSPGSVGSELAYSVSAGYTPPTMSVTGTANTNTNTTKLLKKRASKGAVCSVCDKYISRDIARHMRIHDEVGRFQCVYPKAMCNHKTQNFNRPYDYKKHLLHLHFVFDDPKGKAANTLTDKLPIMGSCEACGARMIANDWLESHILTKNPKLKCPYSKTSYLILPLCLFFSP

SEQ ID NO: 24089 - protein, 92 aa, Candida albicans
QEKQTIEMKENLEKEKEEEKENDYFNQKKKKWGVLLVEINKFPFLTKKKMLGQNFSSHISIDEIIEQANTNKQTNIHHYQPFPNDLSDFVYY

SEQ ID NO: 24090 - protein, 72 aa, Candida albicans
  UNSURE (68): Identity of amino acid sequences at the above locations are unknown.
IGNSHNYSDESIPKVHDFIPVFWMNFTLNVGKYSNLIRGAVNSKQFLRLWNYLICRVYGNDLIRGRRXLFHA

SEQ ID NO: 24091 - protein, 75 aa, Candida albicans
LLKSIHQKLISFIFIHHKPILREEKSVKKKYKIFEEAIVQIESSKQSNKQKKKKNKSKIYILQPSQRKKKEHPQL

SEQ ID NO: 24092 - protein, 106 aa, Candida albicans
NVKKQKKTKQKKDRKYDYTLPIAILQRLATFTKCSHDYIKGQSNSRILEGCQIYPSGIKKFKNKDNKITMLRQSLFRARVAFPLRTFTTTRNNRGIIKESAKVLFG

SEQ ID NO: 24093 - protein, 66 aa, Candida albicans
IADVAIAGVDMIAELDNAVVLVIPWGNPEVVADVVADVVVVVELAILQENLKHEGSIQNKILFFDL

SEQ ID NO: 24094 - protein, 93 aa, Candida albicans
SRDLPGPVVEENHLHHHLILQLNLIYLIFIVIYDLMIVNRRHNHRRNNNLLYHHHHHHRHLQILNLPQLRIFLKNYYELINHQIILMNQDQLY

SEQ ID NO: 24095 - protein, 143 aa, Candida albicans
CHSRILSSDGWAIIYGGGLACIDLYSLFKRLVACLDAMIQKKRRKMLNGDINVYKMWVWKEDILGDFIILVLISSTQQKKKKIERKRKVNLRFQFFFFFFFNNIKYLYTVYKSTYLYIYICIYTVSSPKKLNIGKKKGRKILL

SEQ ID NO: 24096 - protein, 129 aa, Candida albicans
KDQRPNKTFQFYQPNWLKEIQMEHLKDNVARTKLFLWKKAKTPEKVVTPREQTQSYTVQDSTPVTITGHREAPTTPRAANTTARKTMTTDVLEMDTSKHTISSNDEASPRKKTNSTVQRLHHGAGRIRT

SEQ ID NO: 24097 - protein, 64 aa, Candida albicans
GYNEHPLFLVTSCGGAYSLFIFCIKLHDWIFNKGSKSHLLVGIYGNDNDQIVLVEFYDISTTQF

SEQ ID NO: 24098 - protein, 74 aa, Candida albicans
PLTTALGCLAFTMLYNPSDERKSGIPALHDIPAPVRTVIFLLLDINLITSCSFIDVSAGILVPELSSKSISIIV

SEQ ID NO: 24099 - protein, 66 aa, Candida albicans
  UNSURE (2): Identity of amino acid sequences at the above locations are unknown.
HXSSDQQQLNEDNTIKNTFKDINYLMLEQNLQLFETFTIQLYVYFKLKHIAHNWATEIPDYSVLLR

SEQ ID NO: 24100 - protein, 177 aa, Candida albicans
SLDFKLLADRCLLDGCIALIKNQLCVGLLFFLELEICLDQIRAFTLKHDVKEELYCNLFDDDDGDGGGVDNKSLCKSRGMHNDKVVKNILNQSLDYFNYGAINEDEYLEIKSSIDVLTNLTNFVDRVPMFINYDTELCFAHLIFDRIGNRVIVLIKDGKYYGVLHKKVLIDYLRRTE

SEQ ID NO: 24101 - protein, 80 aa, Candida albicans
YRFSEIGKRAETRLYFTRAHVSAEKKKRNFNFFSGHWKVLEPTILSKTRVATQPIGRPIYNNWFNNLKFPYLKFETVTPC

SEQ ID NO: 24102 - protein, 97 aa, Candida albicans
FGFTKLKFLSILVQVSVPNLGNSVGIGIAFPPWKMHDNTCVMNLPDQILIHEFKKLTTYVCKVHIVNPFHKKTEEGRSSFLTLDFWNINTSTNHTTK

SEQ ID NO: 24103 - protein, 61 aa, Candida albicans
VLLIFRYFILAAVQKKNRDHSMLCLSLGLIDTIRNKERILRGETSLYHSLRFNFFFILVIK

SEQ ID NO: 24104 - protein, 69 aa, Candida albicans
SWEHLKKKNASRDYTSKFHWFKDQSYKEIDYIEKLIRFSSLTKYPKITEAHKGEERLDTSSKNNNRGCD

SEQ ID NO: 24105 - protein, 64 aa, Candida albicans
SVVEHREIMNEKDRDLSEEWNLIIGYYDQLVKQNAKRNKLCVFFIYRIFFSLFSFCTQNNDKQR

SEQ ID NO: 24106 - protein, 67 aa, Candida albicans
GFFGFEIEPHVCFIIRLFYVKVLLEEFSGSKMKMKKMRRRRANALAEFECKNNIQNSLENTCFCANF

SEQ ID NO: 24107 - protein, 305 aa, Candida albicans
RQGDLSSDDEEDEEEEVNSKETKQESSQTINIDELTSQALAQHQKSTEIESDDDDDNDNGSLDLSLSETEDAATASTSSAEQDFINLLNQFSNRISIYESWDLVEEELLPEFTTYPEFFAISSKLERQKLFQKWCTQQEPKSPQTTINEGAFPTVKLNYLIFLQDFKQDIKQSFYQSFYNSHYQKLNEFNLSSQMKETIFRNYKIMLNDFTKFAKNYKKSNVGDNRNLKVMKLNEFLQNKLHSHITNTADSGPFSVDSNLSDLDNWINLLNHYDIPTDIAENEINFLVGDEKRLNSYIDQLKPTK

SEQ ID NO: 24108 - protein, 63 aa, Candida albicans
SGNVVVDINPDLLAINCFQLRDNPTPRGLTIPIPVTTTRVIILIQNKLGKGVRTNVVYLVGFN

SEQ ID NO: 24109 - protein, 85 aa, Candida albicans
VTRTTKYNYTTNQYRLISNEADFTYNLLEFESNKNFGKREQLYINENKLYWVFGRESQLYLLVPSNQTNIDYTTMTASIREITVL

SEQ ID NO: 24110 - protein, 221 aa, Candida albicans
STSTMFRNVVITVNNTIRKLNQSYKYRGQFLRLQHNSTMLNHNNNNHHHQYRSITNSKPSSLSKYPKFNSTHGKNSLSNNHISSKQLTNISLDQILLNISKCNDYNSLTKYISTINHQYLNSQNSILQLITKWIKFNNKFNNKLPSFNALNGIFESLIRRQHEVTTTKNINYVSNLLTLYLYLYRFNHLALNILPLNLIWIQYGNRLIYNIYFITYLENLF

SEQ ID NO: 24111 - protein, 247 aa, Candida albicans
FNSKEHFFLGAGGNSNIKVIFLHCLTSKPPPHLQQPTLSMNKYISITRSLATAAKKSTTTTTTTTTTTTTTPINNSQPQFKVFDKSTKFLQRSKHAKLTPELSRKKDYLRDEIAIKTIERLAFITRPMDNLLDFGSNAGNFLNQLIKDSKIPSPPLDGKNDDMEVKLIEQLNKDKQIVRDKIKNLIMFDTSKDLLYRDVNETDQNGNFPGKITRCVGNDEETFNHEIFKTDNQYDAVISNLSLTLDY

SEQ ID NO: 24112 - protein, 153 aa, Candida albicans
FKFNIGLLITLSSLNNIHGILKRDGFFMATLFGGDTLYELRTSLQLAELERKGGISPRVSPLIHLNDIGSLLTKAGFSMLTIDSEDIIVNGYPNIINVCEDLQIMGENNGLISRNYLDRDVLIAADQIYKSLHGDEHGLPATFSVIFFIGWKN

SEQ ID NO: 24113 - protein, 62 aa, Candida albicans
  UNSURE (5),(7),(17),(29),(39): Identity of amino acid sequences at the above locations are unknown.
LKFVXIXNEQRKRSDRXFIRAHKYLSMFXLLAWCCPITXISSPLSTNPPLTFPFGVPPIYDN

SEQ ID NO: 24114 - protein, 75 aa, Candida albicans
ITMKVYSLSKKTWIIILVRLVDLLLSAISTLLLNSKLNMHHGYIILSTPQMNGNDNVSINWYLVVVSSTQCATSN

SEQ ID NO: 24115 - protein, 146 aa, Candida albicans
ICNSMGILINKLLGVFKSSKSNSINHNQQQQSLVDTSNGKTVYKGGNMTLNAANSNSIHNPQPTTYIESQTEQFDFLQLPQYQPAISHPRKNSFKGSGGNRRPSSDSMTTVSTVTSRRRSIELVAQELEIENIKNSLPEGFRVDDN

SEQ ID NO: 24116 - protein, 85 aa, Candida albicans
  UNSURE (2): Identity of amino acid sequences at the above locations are unknown.
HXVHVNSLLLPYYRLNPPNSHSRGTNYFLHILPALANTSSTKLFFSFTPFVLSKDPIPYFFLVIPLNNWICSSSHFSSSELKRSN

SEQ ID NO: 24117 - protein, 424 aa, Candida albicans
  UNSURE (4),(5),(6): Identity of amino acid sequences at the above locations are unknown.
HTPXXXTIGEHTIGEDLIMDVNDTSDLSLSSKNKFDLNQFLVYSLNPLSDDNQKFEIGPATAQEKNDTSIIYLSRPNNSGSNRSTYSTQAPEVTNSLDTKSVNTNLYHPSLNFPSKDIDQLSYTTTSSLSQARSNSVSTAITTLTTASSCKSHISPSIAETVNVDVNQFPHNHQLEQIATFQEQTTVCWSSDKIHFLDPLLIQDIDNITTNSLTHQEKINAIGADYSHRFIAFASSPPPPQQQLQLQLQPPPPPPPVPQLQDQDEIQLNTDTKQSSDTLTQEDFDFNKLELLNNQTMEIAIEYQTSAHHLIEYASSSSNVLLGYLEIDVDVDVDVAVPENERSSLQPAFDYKKGCPLSRDSDSTCDELESLESSSNFIYVEQCNSLNPPEVSSSPTKKYILQSNIPSSTIVAGRRNPTFWKTIF

SEQ ID NO: 24118 - protein, 81 aa, Candida albicans
VVMRGGLFFVVSFRRFVPVIIYCCGTEEPKKKVKFYRHKLSINNENFNPTYSTLLTIYISIHLNVKTNFCNFYLLLFLFQH

SEQ ID NO: 24119 - protein, 68 aa, Candida albicans
STNHLGKLFIVTKNILKLILLNFEKTFQLNVAAFLSLLFVITHYRFEKLYSIKIRYPILKKYPLLYQL

SEQ ID NO: 24120 - protein, 434 aa, Candida albicans
FFRNTRDPTYTFHSCFCFNRRFWPEMDNMLDCLKLLLIKHYEWVSAVIIITSILTVTIELLPTLTLEAQWLPTVSGVLHTSSTITQSTKIGLLTTVSLVPVAETQLASRTFSIVGPPIPDTTSLELVVPTKSETRVVTESTVVPVLPPKVTHFTNSSTSNRRYSSESMVDEEFPSEPFMSDEVSIEVYESYTDESCVISTDFSVDVDYSSDLSMNFQTYDTLDTTEMFNTVENFETYDTFGTIESFDIFETSQTFESYETFNETSDLSMFSLTSELFSDLPPPLVQTDTPVSFNPVPSRTNMSEKTIMWEVTNSQGSIITESGIILISGEYQTTVTTFLRDLDQMEGYTKYTKTWEVTNSNGSVVTESGIIDESGSYHTTVTTFPQKDQNWEWAANTVEYTKTWIVTNEDGSIITESGIVGESGLYHIDSAHGK

SEQ ID NO: 24121 - protein, 60 aa, Candida albicans
LSLIIDDVVVVVVVVVGIFEVVGNQLSDILESLSYWLQCLIWSISGQLIMLLKQKEDKLL

SEQ ID NO: 24122 - protein, 194 aa, Candida albicans
KTNSLQPNDQPQPQASVYNATPPMSHPPLHSLPRPNYYQQPLHNQHYFQPMPPHPQFVPRQQQPSYYQQQPLPYGSSPMPQQAPVPMQSYHPHAPPPQQMQYQQYFSQHPNSNPHPHPHPHQHLPPPLSHNGMMMMHSPQHAPMQSPSTMGPMNGGGANNAVMNMVPVGGRHNKNQTTNKANLRAAFVEGSFGI

SEQ ID NO: 24123 - protein, 149 aa, Candida albicans
DPLLMGIALVHVVENASSSYRYVKVVEVDVDVDVDVDVGLSLGVEKSIVDIAFVVEVVHVDDMTALAQVLVVALEKNHKAMVAVDSMKVAVVLEQTVDVVASVGNNVDCAVVVDNSLVEASYVEVDVTLVVLHYIQMLVVVADHLAVSC

SEQ ID NO: 24124 - protein, 244 aa, Candida albicans
  UNSURE (7): Identity of amino acid sequences at the above locations are unknown.
NTKGPGXIVLDASKETLIIVEHKFDEKENIIYGPFPTCKDTGKPLAFKYGINEDINCTIQFTDELYHLFQLYLHEDAPFSCRLPLSSDVLLIEKGGASIPLTFNIRGALSESHIDIDHSMNVLITKPANNDPNQFTFVSAIAYGAGTNTTRAVIGDQVTMTFAVRWLDQLSPVNSNGGQKLPYQDGFYRFPTSFVPISYSLFYFYLLLTSFISGIAMIAFSYKWISLKITKHKYMPVDDESKQD

SEQ ID NO: 24125 - protein, 432 aa, Candida albicans
  UNSURE (429): Identity of amino acid sequences at the above locations are unknown.
FQMTSSQGNDILKFPILNIQEDMDYPVPFQDPYQLALFLQNKQLLIAKRKLVVIKGSIIMKVLTYEEDIVTATYTHFSNSQELEEVLVVSLKKHIHVYYPDGKSYVCSLPFALKNALPFESGLVLQRDQNESLIPHNGALYSNTSHLNSAAILTLVDPMGDFRIVATASTSVISSKEEVMTFPRKDMSKVCSLCVTFNASDGSISIYHVKAPSRTTTFGKTQLARNQKRRYGSITTPNPSRILEEENGTEPLHSISLNMEKKRTSTLLSDISSVGRVSSDCHSLSQDFSGFKKDMILSRIESFGNRLQKDQLRIFNIWFEDQEGVVIFNRIRKECAVLIYRNPSFSRHLSAFKTSCLDCIPLTSTKHEGNLIILTEHQKFSIINPFLGVKSASHTFGNKLKVRSLIDSYDSKLALVFTLGKSTYPRVYXGGK

SEQ ID NO: 24126 - protein, 94 aa, Candida albicans
FAYPIQRTHTKKFEKDISTSPHGINQIKTSEALTIYRILLFNTKYKVTYIYLFSFYYSQCTFCLFDDSGNQTSTNSFTTFSQVETLVDFLMDKI

SEQ ID NO: 24127 - protein, 66 aa, Candida albicans
YILIDPSEALKVTQREHTLLMSFLGKVITSSFDEITDVDAVATIRKSPMGSTKVKIAAEFKCEVLL

SEQ ID NO: 24128 - protein, 64 aa, Candida albicans
GQKLKNDKARPLVSLCISTKLAPAIERADDAKTPHKKRQTNNPPIFGDKAQGMLKMTYKPNDIK

SEQ ID NO: 24129 - protein, 69 aa, Candida albicans
RKHGFLHYIYLLSMLEIPEVVKNTSKITSKDIEKTKNLFLICEDGYCWYFILLFITISYLSDLTEKNSI

SEQ ID NO: 24130 - protein, 75 aa, Candida albicans
FKIKCLKNNMDVDFLKLSWHYFQNNNNNIKIVHLNQHILNKYLYYPESISLTQTTARRFKPKGIFIYFIFRLFLY

SEQ ID NO: 24131 - protein, 121 aa, Candida albicans
DEPALLSSNKEPTSNQEKSNSDTVEKLVETRAGTALDTEIPAGGLQIAEKNVAPEEASNNSEKAQILAQQSVAPQVTNITVDKISNKTEDNRDAVKQTELEHSENLSTSQTELTQAITVEK

SEQ ID NO: 24132 - protein, 79 aa, Candida albicans
FFVFIFVCFCCFIDIVNHFVSNTISPIVKEWGVNYLLTLQIFLFASYLSSFKSYHLHVKGCTNFHINMPANFQMSRIKF

SEQ ID NO: 24133 - protein, 89 aa, Candida albicans
SNKNPKDSLYKDNGLAVLNMTQIINLNNIGNPVLPITIKNEQRICTNAFWLKDIIELDVKVSPKSLNDDCSVKNAHQAGEMELLIIKFI

SEQ ID NO: 24134 - protein, 67 aa, Candida albicans
KFVKNPPRLVVKYIRHLRSYIEIPVEKEEVSLIERLTASGIFLNRKKTTIESSSSKWKIIIKGACRR

SEQ ID NO: 24135 - protein, 231 aa, Candida albicans
NHSRESSGRRSTSSGNINSGGGLKGILRKMSLVDYTPVDSTNQDISHSDTFLGRVLNFGTNQGLSGGGLAPGASRVIREEDEGEWNLDEERRVGFAAHENDRDAFEMQPLNYEDLSEEAKQLIQQHVPGAGASNLDHSQQSSAAPSTEITPSQSPNQHLLNEKSNNNENNQQSTTVESSSSTSSPGEDEELARRRASEARKKAENPFYTPNPDLFLTWNKCRQSRASPSTQ

SEQ ID NO: 24136 - protein, 110 aa, Candida albicans
  UNSURE (83): Identity of amino acid sequences at the above locations are unknown.
CLNNFKQDKTLPISEAERICSKEINSINALVNSSTDNEVGLTKKIENLSLQVHSIIEDSGKEKTPKLTAVEQLELEKRLSKLXNWLQREDKSIEILKDKLTNSLKLIGDK

SEQ ID NO: 24137 - protein, 81 aa, Candida albicans
IMTQVYCVVIVNTILMYIHTGWWLQQLIKIKINYGLSWMFITEEFTNFFFFFALKLIRQREFFLHFISLSIDEFACCLSLF

SEQ ID NO: 24138 - protein, 257 aa, Candida albicans
  UNSURE (31),(72): Identity of amino acid sequences at the above locations are unknown.
TFLKLNPNSCTTTTTTIISNSGSTMTATATXMANTTITKPKKKMINNTNTIDNQNHKNNTNKLLSELKPPNXTLNRTSNLRLNRNMTMTGINHDNISINGSIINEGYEKDEQLTGALLYIISEYPQEEEEDQEEEKQEKEEGVTKSQQNQIIKSKETLSSSSSSHGDNRLIGKLEESSNDGDDEQSNSNLHSLESSNEQQQQKDITTVAEGAEIEIEIETEKEKEEDFYHDNNDSNTSLENFYGLDNEFLFNSITIK

SEQ ID NO: 24139 - protein, 308 aa, Candida albicans
PTNYALKMSIKIDHILKSSKELYPRIIEELSSQFTKKYDKNTKTFAQLNTWKEDELTNTLLKRYQETETTWITKDELINLLDWKLAKGKFRPMLPKLIKSNDNIDVEEITKQGYQYLLDYFKLHTSNDKQKQQPKLLDKFWGEANDQDKIEYSEIIKKSFEKFTLLKGVGPAMASLLANLLIKINPYLTPPFFSDESFSFYYMESFRPGEKIKYNMKEYIEELLPVYLEIISQYPDVTMNTLERGGWALKNYQIQRNEKLANIEIEYITTTTTDNDDNEEEDINRLKLDHKPDLKLVASTPRRKKQKK

SEQ ID NO: 24140 - protein, 716 aa, Candida albicans
MQSSDVPAPMVEKYVTYSLVKELIEVEIEKRGQITENTIKSLRSSINKLYHMNRIVYSIQQPYLVLGDNIVQEIMSTHKDKVQSIKQSSSGKGSSSSSSTPLTSRSNTLKELSETNTEATIFSSLTKTSFEKDNDNENDVEDLDGDIVAASSGVDAFRLSESSKTKLTEAEEYLLKKFNQEVLESENVSTILSSLTPNTFKSYATDMKRFIRFCARHGKTDSVIDEDILNKFLALSVDKSKKSNSKKLRTSLLKLHQLNCEAYNLDYSEGDIVFLINKYLDSSGNQDEYLPPTDTGNQMDLIAKLEEMYISTNEFDGFTEANKILHKNEFKRYALFCSGQGLQHFHVTGETVTQFFITEIVSQDSNIPVKKLRKILKRLLILHKLNAEIFVDYPLVVEGLETVEEFLTSHKTRPGFNPSGSSSTEAASSSSGGTGANTYSGATSSISSLTANVPPLFFNDQGGTGNLLSSEQASGSSGGDNFKDNPAHVRLPLSNEALENEMLQLEPIPPFEKVDKSSKAIGGPIEESGDDDDDDDDDDDVVDVHASEFPPAVNLNPEDDSGNKDEEESEESHYHSKRQKIEILPDTNDLIPAFVMNSNITTVTQLAEEWTLIVKRTKKWGLGWIKNQLDFQIYTSRKVIIDFIEQLLPELSEDNSNKPIIEVDEDYIYDIVKVFDQYMLRKEMGLNDLVRKIEANPIYSKKEFLRILTRRKTTRS

SEQ ID NO: 24141 - protein, 426 aa, Candida albicans
IFKRLYCGFPPSFLPSFFFLLFFKLLCFFWGVFSLIISYHLPMYQSMTVPPFRPYGGDDIRVVSDLSRFDYQPDQKIRSRNPTPPSTINDNVSSSKLTLDTIIPLYSSKIDERPKYSPLRQQEDRSTQYPSPPIQVKEEPTITIPKREKKKVRYSIGVQVPQDNGGIPMKNNPAPPPPVPAPAPAPPPPPPKDIAPRLMPYPQDINNANNLPPMPQPTSQLYPQQQLPPLPYKDSSSITSPQKRLEKKLIKQVMNRPVIQFKADRFGQNYEGEYFTISANFVIYVFEVCCSVVEIVLSSILLQRDQDIGVGYYRYFLADGIISLIVSLLFALQVINYEIRNGIFYCLVSTICKFVSFIFIISHIFPHNTYATHEIWQMRRGVGAIIIISTFLWVTNMTMFVTTLYISRLDLLEELNFDYSEVNKTK

SEQ ID NO: 24142 - protein, 177 aa, Candida albicans
TMRFNYFTILVLINALVLPPEWPNIVKPTLFSLKETKLKLLTSLQSLMPQNIPDYNVSISSFSAIDSINNNGPQQNHIDLQTDNSDTTSLMFIPRELINPTMFKTLGLANLFSNWHGFGDNSNGKTSSDLLSKSRWLNLTAFDRLLIPESFKTFFIFNTLGTTTSTSTPTMISPSST

SEQ ID NO: 24143 - protein, 88 aa, Candida albicans
IEKKTNNEKKSQRKIKFLCFFFISLNITATMGLYARWMALPSKVRYYVGFSTIGFALIGDYVTSRINDEVQARKEIEESSSSPQSTNQ

SEQ ID NO: 24144 - protein, 91 aa, Candida albicans
ERHTQEDYRTDSQQQQQQQSFELIYKNYPINDILDIIELDPMTSKYQWCLLIITPLKRIRFCCHDEEDMMKWFSALKAVVVTQKKKQKEMS

SEQ ID NO: 24145 - protein, 73 aa, Candida albicans
LLVYLKALQYSMSESDHLNSTNNTGNTFISLDQASTIMADQTQGANPQQQPSLLDTKKKEIKNNFSQSHVLHL

SEQ ID NO: 24146 - protein, 79 aa, Candida albicans
LSDWFHGDKQSLLQHEKLYLKYGAAAISGAIHELHSGIPIFTETRHKKNKENDHPIQTISENLLYTISIQPCLCNKQLK

SEQ ID NO: 24147 - protein, 92 aa, Candida albicans
AFHTNQELALAILQQDEDTGGIGDNKKDIMSLVKGTNKSYFAELIGNYQDIFESELDQKPPLRGSWDPKIEVVPHISPPATKQYPLSVPEQE

SEQ ID NO: 24148 - protein, 265 aa, Candida albicans
QIILYQLSLTSLSLYWILSLKLKSLKDHVCRYYGPFMRMVLPTNQTRQELTMPKCLENNKISENEEYESEVVESDSTPIITPVVTPTKKPHIFPTNEPAIPIALRSTPNKIKNNVDRIFGSPSPIKLVLESPLKKHINIEFSDSESIYSTAVSQFGTPKQTTSFLPEVLTQKVGSPPLDACSDSGPTGVVSSMPYKKPHSTKRLRTTTLEISAALRVKNYTDPKNNITVKKFGEEIKREFIDLDNEIPDSESLVFTTALAGPTLN

SEQ ID NO: 24149 - protein, 388 aa, Candida albicans
IIIYTVVYAFQMATEYGDDDGGLYFHSTQMQSIHESLQQEENQRLYLQTSIKKLESFKHVNNDSSNNSNSGAVSVVQIKKKAATKKRKLMARKPNVKKPKSLSEAVRQAFEKDKFAYFTNNQAKIDDFLPGKSTSTEPSTSNQGSLISSDEWNYIKQIYLQKPTKNKTTLKSIRKRIKQYENSGTGMWEIAALNVDVSLNDEDIQHLYALDEEQMVSDDNSSTEDDTDPTQNDGLILTLSQNCSTQRDICHHEKDDQKYILIDSSICETHQQDKSLERHSQKDSDNGNTIPDQNSAITIGEMESTAAHEVEEIFSTPSYVPSNKLNADQDRSDESESSIIMLADNIVSTQPDIVESILDSESEIEIIERPRLQVLRSVYENGTSYKSN

SEQ ID NO: 24150 - protein, 186 aa, Candida albicans
LLHDQINVVECFQTFGEGVMELGMFSSIISSACNNKMSLRTTYPLDYTLSINNKNFFLYIFFFFPPPPFSILTIYIFFNCLLLLFFFSFALFHQTQFIMSSPNTGKSLFNTFTRNLKMVLSNESLPHVSDNENDSKSPMSTSPPQNIPIPQNPSLFHNPHQQPSTPSGNSYLNAVHSGIGPVRSNS

SEQ ID NO: 24151 - protein, 74 aa, Candida albicans
IIFFYCINIVLLLYFLLLTNFHFREKKNGRDTDHQINFHIRTFSTLELLNLIAYFHMTLQFNKGKDVQVYSIIR

SEQ ID NO: 24152 - protein, 66 aa, Candida albicans
SAIIIVFLLFQFTFFLIYYDVANRVGIGNLFIIYKICFGNPSKDTLYTRLNHVDTERVTRLCPLSQ

SEQ ID NO: 24153 - protein, 79 aa, Candida albicans
MVWKRKYTISLSKCSKGNGSCGKSFLCNQIVLYHILDLKVTQNKQSLSVTRVSMILNNNTIRVDQTQIKEGVRIVSFIY

SEQ ID NO: 24154 - protein, 62 aa, Candida albicans
NFPLKRTKHYYEKYKNFRYYEQNVGVTFLAQISIWESGSAFLQDGVHQIRRVLDISSSWVLI

SEQ ID NO: 24155 - protein, 65 aa, Candida albicans
LIVHCIKYGKHLLALLSQIIGWAHKFSCFKFVNPSEVYETNYSSKTILMLRLLLNKNEVYIYTWY

SEQ ID NO: 24156 - protein, 82 aa, Candida albicans
LILVRNNVQNTVKKEYQQNTKRLQDQNTTTRILLKRYLLGNQLPTKVGEEHFGVSIYYISKIKSGFGLFTCQWGCTKTEIFL

SEQ ID NO: 24157 - protein, 311 aa, Candida albicans
TQVRIGPVPSGEDKINLLEECESFIAGTINPFFKQNDRLWDLMYDLDNNEFILSSQLPGDDIEFKNSIISEDAKFLSNLQLSLFNYNDDLTTIQLIFRRHINEIIRILLSSKNFNSNLAPTSQDLILLLDGIGYYWASDTNKLLEISCYQLISKKFHFLLYNGKLIYNLLLPNLSNELNLMIDLHYHLQSLNNPASNSRINEREIWFNILKFLISGKSLEIFLLITYLIPPNSSSSLQSSSVHGGNLTIFDKNKGIELLLLNLFNQDDQVKSNVIMILQELQDNFLCSWCLDKFLKSNLIYELAFSDLIDE

SEQ ID NO: 24158 - protein, 62 aa, Candida albicans
PLFEEFCTTKQVQFRNEAGTKKKNYRLTLFNFQTPLYYNISKRILYYYIIYLQPSEKLYYTF

SEQ ID NO: 24159 - protein, 158 aa, Candida albicans
FIYNQVKNYTIHSKRKNTLLTNMLNIAKSTESRNTILRKLGIFGSIAIGLFIIGKKHIAYQKNHRHELESDSSTLSSRHQDEEFGYVSSRPGFPLTNPNLDYSSPDRKSEYVGSGDAFSTRRPGDRLSLWNMVKMRWFPDEVEESKYYTPSRSDKLDK

SEQ ID NO: 24160 - protein, 64 aa, Candida albicans
EFNCDSNEDEDEEEETEEESINGSTVIANDTSSGDLSWIGYYWVFIYIDNSSFYGVKIEKKIIF

SEQ ID NO: 24161 - protein, 103 aa, Candida albicans
  UNSURE (94): Identity of amino acid sequences at the above locations are unknown.
VLNLRHTYCKRLSINYIGSGLKIETRYLLTNNVFFLTPGILFVYSWQEANVNSSNPLIITNTTHIVMTKITNKYKYMYVCIYKYKCITRKKESXKKKNQTKLR

SEQ ID NO: 24162 - protein, 73 aa, Candida albicans
  UNSURE (27): Identity of amino acid sequences at the above locations are unknown.
RSFDGGRGDFSSFGFNVFCFSICYNEXRKLNQFPFPIPINIQQLLFKTIINKIKLIRLQLKYLNLLLTPLTRG

SEQ ID NO: 24163 - protein, 268 aa, Candida albicans
STWRENKKPDKFMKSHSLPLTVENFLLTFKEYFTVWLNQILYYNHVYEQLTFDQFKSFDLIIYKNRNPQLQGYIEQLIVNVINQLIINQKQSQSKQRQKQKKQQETFNGLYGINCLVYHSTNNTVVRQYTINFHEFIINLNETINELKLHDKDEDNSAIINIESLNWDEIYTQYSTILFHHIQQLKIHEKSLIEERQQDLEVDDLFFKITVDVDQLLYINNYGNWVRLKRDGNRDNDSRDNETQCIFEPIGDVNLELLNFNCYNKVFT

SEQ ID NO: 24164 - protein, 68 aa, Candida albicans
GCICKYVCICRCTSKKILDIFCLEISSVKKKKMCVVELGRQLLSIITNYLHLIFLAIPFFRLFVVILF

SEQ ID NO: 24165 - protein, 153 aa, Candida albicans
HQLIKSTKITMKFSLTLLTATIATIVAAAPAQYTGQAIDSNQVVEIPESAVEAYFPIDDELTPVFGEIDNKPVILIVNGTTLTSGANNEKREAKSKGGFRLTNFGYFEPGKRDANADAGFRLTNFGYFEPGKRDANAEAGFRLTNFGYFEPGK

SEQ ID NO: 24166 - protein, 66 aa, Candida albicans
IKCKVKLRSNKISYKLKIDDNYHQTYHLCYIRVELTDLTKSKQRHLGRVNNLRSTKIHISLTRRYI

SEQ ID NO: 24167 - protein, 71 aa, Candida albicans
KIIHQNNSSEQTVYLIPFSPPLLKCTIKSNYIHYLFATLSYFLGIVITYVIRKYLMLQIHVTDMIKTHCIT

SEQ ID NO: 24168 - protein, 192 aa, Candida albicans
  UNSURE (181),(186),(188): Identity of amino acid sequences at the above locations are unknown.
RTIIRNMSAFLLVNEHANAQVIKKKKVKNATPTSSTKSIISGSDVSSRHRKKVFDINKNRYVDTVSSFDMSVGDIGEERNDLSHNSSNGNHHSVSNTKPFFPPEEYTILRHTYFDEIKNNNNSFDCNSIQALLLSNQFWNNVYQEMKDDSLQSTFDYFPLLPNRAILSQFYQTVINKILKXIFKAXYXKIPP

SEQ ID NO: 24169 - protein, 69 aa, Candida albicans
LLPKESLKWYKVLYFLTSGSSSLPPASTLSFRLSYKSTRLAEIYIYRLAFQLKLIFDFPKRKKDPTNSH

SEQ ID NO: 24170 - protein, 61 aa, Candida albicans
  UNSURE (2): Identity of amino acid sequences at the above locations are unknown.
AXIILLRKWGNVRVCGEVRKKELIKAGFGMTPKYTHKEIASQHSTLIILGVISSIFYFISV

SEQ ID NO: 24171 - protein, 276 aa, Candida albicans
IQINNNLCQLLTMSLDNEHDQFMDNLKPAVPSSSSSLSSLDLSQAEKELNQLQQDKQNLMIQQNQQYLESLFQDHKHQPIKIRNVQITNGQLYRDEFLKYQFRNLLNGEIMSLGNYVKNVNQISKDLINSGIIDNLQVVNNLVNPPMFSKSQAYHVVPVFNIVPLKRFFAKTGTNIGNGEGDGYIQFQFKNLFGGGENLIFDAITGTKTKSSYLLNYNQPIGNNLQYMNENLLLINTRNLDWLQSNVPTRGMINKLYTRFHGDITCLNHEIILENN

SEQ ID NO: 24172 - protein, 70 aa, Candida albicans
FELSYCNWGDVYILMQKKKNTNGLVFTHTRTHTHAEKEVAKSCRNKTYFSLGATNFSHQETSFQSINSNQ

SEQ ID NO: 24173 - protein, 69 aa, Candida albicans
FRSFNNISLVIPSHMFSGTVSKSIMNGLYLYFALILWSKEDNSKTKWDKILPVPSVFTSKVHRSPQYSP

SEQ ID NO: 24174 - protein, 79 aa, Candida albicans
YNNNWKDEVIGSYGFGFSSLPVYYKPCLHLSTNRVIKAEANTTFFLLTYHHVIDQEKGMLKLNITCKTFVTYFWLNNPL

SEQ ID NO: 24175 - protein, 484 aa, Candida albicans
NIVFKNKEFYLFVMPQRIMLQFMPISKSTDIDLNAHEDSSNLDNSGSTTKTSGHEIVNISKVPNNGNEHSEYEVNGVNGLSILEHSSPEPKRKTTTYQERVSYIPNHDFTGNKSSIFESSPQPSIPNTFKYKSHPNAKAKALGSTQITEETSQEQQEQNGDVQPPLSTKQTPKNNNKENTTPRWMPPVLDEKWNVQDLEDIKFTPSMPSIQPQHHQQPLSNQSRGGISPSPFQDFEIHTGDTMIHNSNVQSVETPGYRRARQDYEKQKGPDMLKSIFPTVGGGSGGSGGGAGPDETNTKDHSTSSTISSMFGTIQKRPEEIKQQMETINEMKNMKNPESPLKLYGPKYNTYTRNQLAGLVENLKSNKNTPAQNQNQNQNKNQNQNQNQATSTPSPNSVLSKPPALNLNSKIVNTPPKNIKSFTKTGAYDEKSYLKNAENIFPILKVKDLRSITTTTTIIMVLELYHRRQTHLLPRRKLVMVNPS

SEQ ID NO: 24176 - protein, 70 aa, Candida albicans
  UNSURE (50): Identity of amino acid sequences at the above locations are unknown.
SEQKIFEYGFKDRLDDFMNVPEPVTLGVKYWIPFKSPLFLHLLGSSHSIXNATVFVPQTGRLPIYLMVPK

SEQ ID NO: 24177 - protein, 81 aa, Candida albicans
RNRSLDISLLTQDLELQEIVTTPTNEELDNLIEVYTKKIENLSLELEKCRYNTSVTGDQNELKKYVVQLTKARKERIIMVC

SEQ ID NO: 24178 - protein, 69 aa, Candida albicans
SKKPQCLELKRKSSNRFYQNRRKETSSFLQSSIMYYSFPFDVLYVVCEARLRIGATQMKAFNNIIITYY

SEQ ID NO: 24179 - protein, 61 aa, Candida albicans
KINAKLSTWLCSYSSQQGCRYNKQFSTTTVLDVVTSLQSTNIQARKLELCIRIHSNSLQKC

SEQ ID NO: 24180 - protein, 79 aa, Candida albicans
IPRPLTIRVISYFSITRKLNNRRPSYTTSSRASNLTIIKKPTRINSLISLDDNTNNTHGFKIHLQYEFEICFGIEQISL

SEQ ID NO: 24181 - protein, 64 aa, Candida albicans
TSFSGCRNQFRDLQAIKLFVQPHQLFECVIYILCPMEVHHNESFSQSYSLVFEKTSIFFSCRFL

SEQ ID NO: 24182 - protein, 60 aa, Candida albicans
LANMLPSEAPFAIVELPNDDIWMNKTKNDVCVDEMQKKKKIKYIWILLFSKFGTIDINQT

SEQ ID NO: 24183 - protein, 62 aa, Candida albicans
TFESKTDAHIPALPDPNSKMVNVFDNWNGHSGEINQSMKKIEDCPHINPVVFDNSRRKTIPP

SEQ ID NO: 24184 - protein, 67 aa, Candida albicans
KKKEHFANFRDHSSFWNAADINIVKENINNLINSLKYSKLHNHSLDHHLTNDQVHYIVIVPRFEQLR

SEQ ID NO: 24185 - protein, 60 aa, Candida albicans
  UNSURE (3),(6),(21),(45),(53),(54): Identity of amino acid sequences at the above locations are unknown.
YIXIIXQLYKQAYFQEIYFPXFQLNILFLDNYIILYNFISSRAFXHRHESANXXLVCSPE

SEQ ID NO: 24186 - protein, 104 aa, Candida albicans
SACPSIPVVKKSTVATAAASAPAPAPTVSRPVGHPGNESTLRIHRPGGHPGFESTLTVHKPTVTNRNENRKFSPVPNPTAQDNSKKRTNEGQHQRPQIKKPKDS

SEQ ID NO: 24187 - protein, 69 aa, Candida albicans
FAIRLCIQINMIVNRVNLTLYNEGSCLTYIYFGITHYSLSSSPTFSNYEKFPAVQIGANQNSILIFVDQ

SEQ ID NO: 24188 - protein, 71 aa, Candida albicans
IPEFILSFVLLDFLKDDSNQLKQKNIQNFSNFKSLKYLDWANYKEMETLKKREKKTENMKWILHLGIYIKK

SEQ ID NO: 24189 - protein, 133 aa, Candida albicans
  UNSURE (7): Identity of amino acid sequences at the above locations are unknown.
STTQRIXEKIQKLMRLQSYIQLSLVPYHLYPMILEPYLQGIYIGYMEDAKKSPANGREYSYVDVLIAFVKGSQLEVANANAQVELFNILPVPGQTVGDFIDAIQGKYRQLKQYNNVFVSVRAHVFTHCHKYFI

SEQ ID NO: 24190 - protein, 70 aa, Candida albicans
GYKNSYTRNMQKKTKVGGNKGGLYSEEICLSAFVANTFNTLFLVYVVRDSCGEYAGCGYNSRPSISLVIG

SEQ ID NO: 24191 - protein, 71 aa, Candida albicans
  UNSURE (19): Identity of amino acid sequences at the above locations are unknown.
TANTVVNRNQRQKGKEREXKKGHIYTYTLNLKEKNKTRETKNRDQENTFQQRKIEILVIFTNQKKNTQLVY

SEQ ID NO: 24192 - protein, 81 aa, Candida albicans
KGHESISQISNPVVVWYSLRNINYMCVLCFKLIESSAFSVFNFSCSRTAGSKSFQNLASYLVKHSGSYKIFVAVCEYMCSN

SEQ ID NO: 24193 - protein, 60 aa, Candida albicans
FLLTTVFAVQNEKSTCKRYNNNNNKSVTTLELLGCQIFPQVSQHYIYIIIQLFLDILYIS

SEQ ID NO: 24194 - protein, 62 aa, Candida albicans
SLTDQVIAVLKEASITMPDGVPVDYVAENLSITKEESQFQLLKLNDEGKAYAGYDDNSYLVI

SEQ ID NO: 24195 - protein, 74 aa, Candida albicans
GKREIKKHQKEWDRTRRNLSILNKKLERVRIFFHNFNSYSCIINTQHTIMVILNLFLNTFLFAGVNTIDNIIYS

SEQ ID NO: 24196 - protein, 95 aa, Candida albicans
KSEEHGVHFLGTILVDVISTIQLWSSNEIPDCLKIEQTIKQYTASLFFLNAEQDLVIVRVSQLLDPTENGTMRLTNGNMASGEMVQEKDKIKRLN

SEQ ID NO: 24197 - protein, 88 aa, Candida albicans
PMTVMETDNGWRLVVVIVLLQLCTPPPPPPLAANICLHEIQSNRNPAKEENQIRLSSKKIEINSHKKKRRNSITKIYYYHHNNTNDSK

SEQ ID NO: 24198 - protein, 79 aa, Candida albicans
FSSLAGFLLLCISCKQMFAANGGGGGGVHNCNNTITTTKRHPLSVSITVIGHFYVTRSLSQRTACFSFLPPAWRIYIGG

SEQ ID NO: 24199 - protein, 535 aa, Candida albicans
QTIVFCLLNTTAGEMKSTTAANVDFFENLTSLPLDIIARIIAYLPRCILPEILSFARIRDIVASEILSAVDITDWTRNCYKNNAARTRASHCICNVFTIKPKNFKLAMDQWHMHPKLLKIGDFSTFQYILETDPEILHKAIHLHGRFHPENIDDPNPSFELLINSGTRFDSLFSSSFGNVHSLPAITKNLQLSSTILEDYNIGGLKKLSLDMTLHSETEVPYNLYSNMEELHLLLCYPTNMILPKKLRKLIVDTSHENRVAFAPQALFNLEYIKYFQSCMKSLNETRLVTPNLKLLYLSCCHKFSDFGSLKRLKHLQDLKIYDCIYPIDLFNGKAFSELRRFEYTASSIDGKLPNFEVPETFKNLTLTFPANLKVLSINNAMFMKINLNTLKLPTSLTNLKLSNTPLSEGYLYFPENLRFIEIDVPKVSFKSDFQLPRAAVQVTIEADIIIFEGTDFIYNLPEKLSHLTLKAGFKGAIVPLTQKVKWPSLMKYFYLKNFYTDEEQLRLLNLKESNLQTIEIFRGRVKKLPDDLFP

SEQ ID NO: 24200 - protein, 136 aa, Candida albicans
IRKGYVRVHLFFFFELREQPPKKIYIESIQYSLQYFTSINSTNHSLIMSSSLGAPYNEYARLYDVGSSPVESSPSTTYTTVFTVLLLLLAFGSLSMALLSDVKLKSAVSYTLHAIVASISIGLSAIYVSNYVGVYI

SEQ ID NO: 24201 - protein, 71 aa, Candida albicans
RCYITSVCFTESFVNIDLMETSDRKKIIPLVYILLVGAGQAIVLGSKYKVVCLFLTQEILYRLRHDCITPY

SEQ ID NO: 24202 - protein, 103 aa, Candida albicans
LQVIRIFNLVRREARRGEGEVKIVCVCICACVNQNVLNFLIGKVYTLTHTLYIYTPTYIYIYSKLVTSLTIRDHLTSNLITNLQIYSFTYMYLLTFFNTNFIL

SEQ ID NO: 24203 - protein, 243 aa, Candida albicans
SNMERRIRFRRLFQDSSDQQYQQPQQQGLGVSRRSTLNRFDSPTSLTPTNTLQTTVDPIIITRAIHDYNDDDEDNNTIYATTTQPLHRSNTTTYTSHFTRPKVTTILSLPQKLLQWIYSISLILILLLLLLVISVTILDVVIQTLQSPSDLALKTFTVLGACGFFIFISIIIYFVRLYQLRVSINNIPNKSLYIPFENDFANKAIFHYIDDKLKYCHEIKFKSGPLQNAILQPRRLEGSRSGD

SEQ ID NO: 24204 - protein, 120 aa, Candida albicans
KYILKFIFKSYNILLLTTALYLISLIIHNEQVINQILTSIIPIFLLICQSCLGTIYIKKHKVANNDKQIIINVFVNFISSFLSLPSLIIIPLNPDEQIANNGPPKQAVNAIIGFPIMAIV

SEQ ID NO: 24205 - protein, 328 aa, Candida albicans
  UNSURE (63): Identity of amino acid sequences at the above locations are unknown.
SVFDRIFNLLNNYYLFLAVLMYSRARPTKRKRRVKEKKKKILPLDLQLTSHNQPPPPPPPPRXMSLITKTIIFKRTLTTKFSTEEAKKQAAAQLAIQSLKDFGSLLSNSSEDTQPIDTQPIYNNPELFASLSLLHQGQVIKELQDKFDKDWLKLTLKDKKLSYYIAYGNWGVREKFINWNNPNEPPLDLPFKLPTTTIIKSRNPADDVKTKTIIKKLPMVNLNETEVRKEQFDIKRMDGVTKFFIYLMIFMSLLAIARDKNIGENGKPEQIIIEDKYEIQRQERLKKKEEEEEEEEEKEKERLRIELEEKRQFELAKKNKKWYYLWLK

SEQ ID NO: 24206 - protein, 78 aa, Candida albicans
QQQLIRRRKNCLSIEMRNYSFITLSFFLHFFTQFNLNLTTILIFADFSWYYFCILQSINENVKRKTKLINTFISSLIY

SEQ ID NO: 24207 - protein, 68 aa, Candida albicans
  UNSURE (63): Identity of amino acid sequences at the above locations are unknown.
DPIFAQGRVQKPYGSNKEVEGREKSVLFVVRERGELKRGGIPYEERKGREKGSPPPAPRKLRXNSHNN

SEQ ID NO: 24208 - protein, 85 aa, Candida albicans
KKGTQIELFVLTKSIDARINYAFIHSPPHHSPREPTHSTVTDNNIDTSLLLLLQANLKFEIVTKNNRNRNTEAKKKKKNCKTKEQ

SEQ ID NO: 24209 - protein, 98 aa, Candida albicans
FKYQLLFESIYITLFVGVANFALVHIQLIPFFTPTHFFIKITSFIVYFCIHYKTKKPKKKKKRSQHIYKYFSNPRLFTIKTSFLYQPYNSFFFQFNTS

SEQ ID NO: 24210 - protein, 120 aa, Candida albicans
YRVCKTIPFLAFNEHDLCLCNKIENRNEMSFSSGKFLFVFLFFFFFKNTSCSNQRKYITKQQTMSKDKKEHKDKKRKHDNEDVEIADSKKQRKLETQEKKDKKDIKDKKEKKEKKEKKHK

SEQ ID NO: 24211 - protein, 85 aa, Candida albicans
PFFHASDSTRNSKSLHFNISNTVQNITNNDVNPLNNLTQSVSTHQCLIITCQKNSIIQNFLLYKKISNYLIILTSNTYTQRTNKL

SEQ ID NO: 24212 - protein, 65 aa, Candida albicans
CGYIKDNELLELNEKDGATNVEKLDEAEISLSSLNGRDDESEFKLEDESKLLSSLSGMWTEPAHR

SEQ ID NO: 24213 - protein, 90 aa, Candida albicans
DVANDHKLETITWSFTIKLDGCNFVIRKLYIVTPSYHSNTNFSTTIKINNTLINNRIRFERINRFPDFQLRLPVTACINASAKVWKTECV

SEQ ID NO: 24214 - protein, 115 aa, Candida albicans
LQMAYGIRLIGGIITLYLFYVWTFVCPLTTIDTESTNSLTPINHHFCSLSNKYIKPQFYPIYQAHINPVLINLDESLHVGENIDKSIEIIHNFNHQYQISDSYHRASSPEAADQR

SEQ ID NO: 24215 - protein, 74 aa, Candida albicans
TGGEANYADNVNSGHFFLLQSFINSQIGIIRARWQSVLYGGCGVIYKGIKSLAKTKKKPIRKYPGNSSSSLLLL

SEQ ID NO: 24216 - protein, 116 aa, Candida albicans
LYSYLLKILSMVFTVNETDFFIKLAELPSEVTTLIVGFLPKCMLPELLYFPPIREIVAGMICLDVNIIAESERDKAIDEPCIEYSKCTCKQFLITLDDLRKGIRQCNIFPRSIDIR

SEQ ID NO: 24217 - protein, 616 aa, Candida albicans
GKVFVNAIYFRDPLILDSAAQLRSVVNTFPELLMDALSINCFFDGKEFWSRYPENSLRLFLGSKIKLDFLSLSNFSNPLTILPVVKRIKLLNTVLTSYEIPGVKKMDINLAPTGVEDQIYTFSSDLKELQIKTKRSIKVSLPPNLWKLVIGTHLSSVDFVSEELLNLKVLSLSLPNIEFFHETGIVAPNLTKLVLTNCGNLSNYDELRQFHHLKHLLVENSSYPIDLFSEDSFPKLDKLEYRGCYMPNLEGSSNTLLKFPTKLKELKIEKAGFEKVDFSNLVLPTGLQILNLRGISFNGGYLSDGLRRVYIRTSKVTLKSNFRIPHTVENILLEANYLILHGLNFMCHLSTNLQQLHLIANDLGKIHPTTKMVAWPLSLNDFVFQNLNIDYRTLELLNLKESRLEKIDIQKGNIKTLNADLFPASVKDLSLRGMGIQQLSDSFENLENLQKLSLAGNELRELTSVKLPMATLEFLDVRHCNLRFISPFLVSMIDKKNKKAKLRVEATGNWNVSVVDIRRALKASKGLSLYLSKLDEDLVEISKRSSRLHFNGELLDTYIKKPKTDNFYNGSDSNLDEQSDVGVMKSLSSEQFPVANQQRRNRNRKKQSFDVRTFLP

SEQ ID NO: 24218 - protein, 73 aa, Candida albicans
SASDKEKKIAAIFFFFSRQRKNLILFSGPTLTRRIMTHNFQYSKLYNQLEISYKLKFLSQSYTLIYSLTFTIF

SEQ ID NO: 24219 - protein, 71 aa, Candida albicans
QVKHSTLKFAIQTLLITHYLTLEKISRVFEVFSIYKKTHESIEVKYVYVFILLYAMNKLNHREINYMLTKK

SEQ ID NO: 24220 - protein, 73 aa, Candida albicans
FPVSLLFFLEVIKEFGLLLLNILSRPEDVFYETWIFPARDCRGGSSERVSECTTFYTVTINNKSGRKDTHKRS

SEQ ID NO: 24221 - protein, 60 aa, Candida albicans
LHVSPGRRLLDTLRKFSWNHLTIFNSGWNYFSFQVNLSIFCLANLTFTSKQYLVHSFRKC

SEQ ID NO: 24222 - protein, 94 aa, Candida albicans
  UNSURE (80),(81),(82),(83),(87),(89): Identity of amino acid sequences at the above locations are unknown.
KIKLTLEKKKKKKEKKISLKDKDKEKNEPPPPPKEKSIEQNSFNKQNHHKTMHMIQRVSSIGLRTLRSSNIGSIRWPNHXXXXWNSXSXRLMRT

SEQ ID NO: 24223 - protein, 65 aa, Candida albicans
LAPRGTRTRDPELACHGINLHKTPEAQMLTNCTRGAYTTLSRDTLLSRDHNHNHCAMSVISLKKI

SEQ ID NO: 24224 - protein, 71 aa, Candida albicans
GYSPNVLYMQYQKYFCYAQFVLPNTLYIYIFFFLSRGATLDHSAKNSSLYTLTQFEDIQIFFKKKFLLDRY

SEQ ID NO: 24225 - protein, 61 aa, Candida albicans
WLYFLKTDFIDINCSYILDCRATQTQTHTEISVETAGGSGCGSSGDRDRKVFSWCHHRCRE

SEQ ID NO: 24226 - protein, 97 aa, Candida albicans
SSSGYGSSHTGTAAGAGAGAGYGAATTGSGHGDSSYGQTSTGHGTHSSGSHQGLSSKFKTGVDHLDAKIAQLPEHLQKEAHKEFERGYNDAKKSFKS

SEQ ID NO: 24227 - protein, 61 aa, Candida albicans
KHQGQEKGHRLNLPHFKKDFFTIISIYSQRFPSNVHFLIFFLFSFFYVLVLVFFSYQFFKL

SEQ ID NO: 24228 - protein, 76 aa, Candida albicans
  UNSURE (18): Identity of amino acid sequences at the above locations are unknown.
PGAGPIFTASPPVFFIEXITFKEPDTSGEQTSSDQVQDTSGDDQEDLHRHIGTKVVQQGTHCKTTNYTNNNWDWER

SEQ ID NO: 24229 - protein, 67 aa, Candida albicans
  UNSURE (51): Identity of amino acid sequences at the above locations are unknown.
SVDQRKKKNFSSPKRVMIPRNKPPMENPWVPYSFELNPGKKKKEEPLNWRXIFTPDKKRCDKFPFIR

SEQ ID NO: 24230 - protein, 72 aa, Candida albicans
LKSDKTFTGLSETSNNNNNTNGINFVDDFHVGNEFGDIDFEHHYSQDHHQQQQKNDNNNGNTNLDSFIDFEN

SEQ ID NO: 24231 - protein, 125 aa, Candida albicans
HHILSLTKLSIIMFLHNLLNKHHQHNQPHHPHHHHHRQHHHHDMKHNIYSNYYPGHTYAATAPPPGSPPPEYGFNHSPFNAHHHYHHNHNRRHSFGPHHEHGHFDGPMGSHGHHHHEHHGPHHHR

SEQ ID NO: 24232 - protein, 80 aa, Candida albicans
PFSNKIQINFEKTKNLKSNEIPFEVLTYLQPNRINDDDEVHDVHGGGGHVIPLAHQNGHVHDEDQMNDDDYDYDDNDDGH

SEQ ID NO: 24233 - protein, 64 aa, Candida albicans
SEFFHFQTIQEQDCLLCLSNNYFMSLRNCFNYLHSVLLSNLAIYCVWLAQFNFQTQILLLLKQK

SEQ ID NO: 24234 - protein, 64 aa, Candida albicans
LYIGSGGYPSSNRRHSLMKRRRLKKQSSRHCREKGLSWRKNNNDINDNGYCFELKNMILLKRIE

SEQ ID NO: 24235 - protein, 241 aa, Candida albicans
KTIRPMHQRNHHSILLTLLLYLQSIVALARIIDPEFGTYLNPNPRKYPQCQANDLVKLSSCCNELLHKLDQCKSDDLACECCALQLIDRDCYHLCPGNPLTNFLTVLLQDCAQLSEINACALPFKKTDDLLVDKKKGTPNSKSAVQALEADEKYDASLKSKVHNKVDEIKSHVKQDQFLKKKIKLLIDKDETFAIQNHSNNSNNTISAKSESGSVCLTSSYLNSPIIILCAILTGTLFAMY

SEQ ID NO: 24236 - protein, 276 aa, Candida albicans
AITRSDQFLRVLKGTGIELDEIYTLHAIVAENSPVTITSKLRIAFAEDYLTPNDSALIFPEVNEAVLHKRRKLDQDSKQRDHKGFRFVNFDKLQGIGAASYKDAEPKQPSSTMILTDWNSEGRGYRPVLGLSPLTVTSVAGKNFKNPTNREAIELIGYLILRELLFKWAMTNLKIKPIDIVKGFLASVRSTKLMEQSTAGYTKLDLIHAVQAYVGLKYLEENTIDGIAKWYKTRLETRDLNFYFDKDTWITKQKPDLESPFLNRGEGRPRLIYPPS

SEQ ID NO: 24237 - protein, 338 aa, Candida albicans
VFFSSPSLSTSKPMFFRLHPVKRRNGLRQLWQHSNVALETLPAIARRTNEYLCKLENHPLKSFASLGRVIKFQNATKRRIDVSRNLDLEIQSAFNQVIKLRHWFSNKKVLESTVDLINRDWGQILIMKVQLDQVFTSDHVPTATEQEEIDKLIHNVVKKIFDFNLDFGMKLDKLYPPVIKYYQTDDSTNYVQATLKLQTLQLTKPNCNVQTISKKFQNLHKLASSRTTSRLASYGCLNKTSSGVSQQIILSKVLQARICNRIKQTITNRGKVKILGGKPMASATILQVGEESRVSIKTNVFLEKYTLKHPSIYYKRDLSEMSNYAVRSIFEGTQGDRH

SEQ ID NO: 24238 - protein, 63 aa, Candida albicans
PIPKVVPDEEPELPAELPDPEPEPKPEPSIGFKETDPEAEAAADALPPSLPPPNKNPNKPSAE

SEQ ID NO: 24239 - protein, 393 aa, Candida albicans
LINTLFLLVAFVSLLVKQIYYYTHTLLYTHFIPTTTYLYTMVSASTIKVLPPANGKKLWRVRKSTPNTHQRSNSLPGNKSTTSPILLKSNRSCSTSSIASTTATANNNTNNSSPMQSSSIECLNNSLKIVAAASKFTIKRPPLRRPKNKPGKPKDFVFVDLSPVQSDISSESESNTATITVSKSRRSSNSGSSVTKANLINVPVLPTNVAPATPMTTSNSINSINEYDIYGKTQVNDAYAAAAAAPMEPLLSNDGFGLPSPVESLDDFLISEFDLWENEVNWQSMIPNTQQQQPQQQQATSPAVSPILPTESQQQGQYQEYFDIVLIVQQQQEQIQKLQQQLQQITKTNSDNGNTLAQVDMINSLINNANSIPITASTAATTATTNGFMDFVF

SEQ ID NO: 24240 - protein, 74 aa, Candida albicans
SIFVKVAYIFSGPYYFVTLDKPPKNNAKPTYYYYRQKKKIFCLTKMNCKYNSHNKKKMQNNNGTSSSSHLHNNN

SEQ ID NO: 24241 - protein, 63 aa, Candida albicans
ILKFFFCILSFSSFFINLFIHLYILIYKNNYIQLIHLEERSIDKEQKKVFKTRFFKYACHRNR

SEQ ID NO: 24242 - protein, 61 aa, Candida albicans
QRCGFAPIFNEYPVQKRTQNHLLLLLLRFSNKHQNETWNSLTCMYNILGNSEMNTWNRIAG

SEQ ID NO: 24243 - protein, 62 aa, Candida albicans
EESYSFHYYVIYKTRFEKRYNLYIQQINSKMQIYFLNQSIFLNIINTFVQFSVSPRGWKDPR

SEQ ID NO: 24244 - protein, 77 aa, Candida albicans
ILEMINLDVKEYNAAQQEIDKSNVFEIIKNYMMSNGGVNNHNNNNIFANLQRNLLELNEKDNKDHLFTLINLENDFM

SEQ ID NO: 24245 - protein, 120 aa, Candida albicans
FQVQSVCIFTILFAMSNNQSYSLKNQLYKAKGEVLKLQRILRTSQNEVDRLNDNLDRVYDEKHDVIDDLESLKRRYEELKRNYEKISRQKEFYQRCYQNCEAVLNNDGSARKNQSFKGVF

SEQ ID NO: 24246 - protein, 178 aa, Candida albicans
LNAGVVMKLFGVGNMKVNSLRVSYPEPLHCRFCGSAAISSFSVVYEIEGVVVVHTFRVDKKAICLRVERDPREIRCVGFGGAQEKVDWYENVVGYEVTSVNLMIGVVQKSSGLRNRKVRQPKEYELMVVSLGSGKAEYYEYNVDGVLWGVERYRHNSVILNQGRRMEVVYVGNSKLVD

SEQ ID NO: 24247 - protein, 149 aa, Candida albicans
FEIYGLKIPKFINKIQPPKQGDNHQQIVPWYKFLMHQNDELDKALSATRVPPTHLKTAIKAWIELNKPETRTPENDLYTTIDESYSPTKNYISKDFAPSTDTKYYNSSSKKLQLAKREVLTPLGWTERLDISTEQWKSTLEKLQQNGQK

SEQ ID NO: 24248 - protein, 72 aa, Candida albicans
AVFARKKLSVLLNRKEEVFEKFVISFRGVYVLFILRSEPLDAYVKVTHIISIISNVHVLWPQLLCCRVSSRH

SEQ ID NO: 24249 - protein, 64 aa, Candida albicans
IPFLTSLSSTTTTSVAFIYTTLEQIETHYQPYLTNIMFIRSTLVQTRISRDISVVERYLTAEHL

SEQ ID NO: 24250 - protein, 63 aa, Candida albicans
LLVYLKALQYSMSESDHLNSTNNTGNTFISLDQASTIMADQTQGANPQHFVVVNLKFKEKGGN

SEQ ID NO: 24251 - protein, 68 aa, Candida albicans
EMSKKKNYKSSLEGVITKLQMECDNRMRITDYHYKNGNLQLNYSYLLISDSSNLLEILKSCTKSSHNR

SEQ ID NO: 24252 - protein, 90 aa, Candida albicans
KRDNYSNFRDGMACNKIMESWNLFVDVCILHLLEEKKGEFININVCLSVNHQFRDQEDQKTGIKWCSFGILFSKFIHERLLQQVSFINLL

SEQ ID NO: 24253 - protein, 70 aa, Candida albicans
FLSSNFNKLVYKFTMESGRLSNYLEAAYIPPQKPTIKQEVPSYHPCLIVQDKQTDVTKLKPCGCADTYCV

SEQ ID NO: 24254 - protein, 78 aa, Candida albicans
LKSPVQVLVFVAIVVFNKLRFDSNQYTKVVVEQMDLKVNQTLAQINSPQLSQLYQNARAGALKYLSLIKLPKESGKKK

SEQ ID NO: 24255 - protein, 175 aa, Candida albicans
SIGIDAAFCSVELLSELPKYNQLGLFSCTDINVCDIALFAILVFLKIDRSDTTLLFLRKGLSILKIMSDGSASGKLALQRFRKLDKLVCDLTELDDMDTDLNPHNVLGHESASKAFPMDTSNQDAVLEFGNLPYVDSSANLGGYMNTQQYFFDDMDNILMSVDDDIFNLQKWLDI

SEQ ID NO: 24256 - protein, 67 aa, Candida albicans
FFSSSLSLLFLSFYSIYHYNYNPLNSTSNKRNLFFFFSNLNKEKKKKKKKQSQLINDSCLNNQLKGK

SEQ ID NO: 24257 - protein, 66 aa, Candida albicans
YYFYEKVESEIKIHLFIYSGEKKKSNCSKNDKYQLRKKVTKRKLGGGSPKVLSPMVVPLTQEQKKH

SEQ ID NO: 24258 - protein, 78 aa, Candida albicans
  UNSURE (2),(7),(11): Identity of amino acid sequences at the above locations are unknown.
GXGPRRXKLKXIRDNLISNENENGNSPIKEEEERRHCLTTTTEKKKKMKQTHYTTLINKQVNKGSNVRDTTRKKKEGN

SEQ ID NO: 24259 - protein, 73 aa, Candida albicans
DILFNLGNHNLKNRDLAGWFYTIQIQKRDNKLNILGFDKNVVINNIFELHFFAIKKIICEVKLELFPSSSLVV

SEQ ID NO: 24260 - protein, 120 aa, Candida albicans
  UNSURE (53),(119),(120): Identity of amino acid sequences at the above locations are unknown.
LFYWALINESRSCEKHLAKKPHSSGNLSEWLRRKIRNLLGFARAGSSPAVVVXFFTYDLAYFVNVFFFLSLVHKYHFTFTELCTLHSSVRSLIFVLLFSLTYQPTNCQCFNTHTTDNHXX

SEQ ID NO: 24261 - protein, 138 aa, Candida albicans
  UNSURE (44): Identity of amino acid sequences at the above locations are unknown.
KLIAMAKYCANEQGYAVKKLTKVHGPDFLGAPMYLVWLVLLVNXYDPTILRKLFANDALFNKLIGYLPGWTFALYRDMEKNAHRHIIGLAIAHLGEILFFTKGYLAKYRAPENQRWIWYVMNFFEGFPVMLRLRRATK

SEQ ID NO: 24262 - protein, 60 aa, Candida albicans
RGRRSKLAPIQFVLAIDSLYDHKCMQAVDNCSQSMTIEKEFNDVVYLLLFYFSPIHWILM

SEQ ID NO: 24263 - protein, 65 aa, Candida albicans
CRQQLIRKKPFDLVSSIQRTKKSNTKDNIHYNCAKSHVLNATKFILLFWVHTHIYIYLYILNINH

SEQ ID NO: 24264 - protein, 84 aa, Candida albicans
TNSLIEKESKKKKKEKNQLWKKKIQVLLNTGNELKKGQLEDKKCTKKTDQDGDDKHYHHHPDMDSAKKQDGGQKKYVVRILVAE

SEQ ID NO: 24265 - protein, 61 aa, Candida albicans
LDVVSGELLDRLMWESDLSEFAVSVSTFSASVEAKDEGMVASLSIIMNYNPLLDQMKLMLC

SEQ ID NO: 24266 - protein, 82 aa, Candida albicans
EYSIQYKEKEMKIEKVATGNGEEVGGKKQTIKRTNSRKKKMANQISQSTWKKKSIENQASWKKTTNCDAEWLRHLSLLILKK

SEQ ID NO: 24267 - protein, 88 aa, Candida albicans
HFSTLSFNILSIQENMADKIKEKNQYHLLKSKYPGVGDPDTTREEFLTTIHNDTVGALAHHHHLLLYNSLITNEHPYQLKQKFIRKLK

SEQ ID NO: 24268 - protein, 103 aa, Candida albicans
FHIHKLFGRILANVFIWDFFLVPGVFLLLFNDWAIGFTNAYLMFALAFGQLSTKVFALQWIFAFVIAGILTVWSFIALVVGGVREVSDERAPLLVEVQETVTE

SEQ ID NO: 24269 - protein, 68 aa, Candida albicans
QFGVLSLWLLVVSERFLMKEHHYWLKSKKLSPNNLTKTLEKKDISYAGVSYYVLCSVYFSFRINFCFN

SEQ ID NO: 24270 - protein, 81 aa, Candida albicans
LGVSGLNICKMRTVILLYARLSLVSQPKPLLFCVSLSYRRLALFGETKNPKESNFAERLIQTKILSLSVVVVAKRGQKKKR

SEQ ID NO: 24271 - protein, 60 aa, Candida albicans
SLWKVLVLSFGGLTFERHPTISNPIEELLSLQICVINQKYIYMYISSFIYISLLHKYLVT

SEQ ID NO: 24272 - protein, 147 aa, Candida albicans
TFKILAPTNNDKAMITRILKLRLFFGQMVLNNDFNINDSLFSLLLLPLLVVSLSCIGGFTLGGGFSNVLGVVFEVEVEVEVDFNDDDDEVDLKLEVDLLVKYLILDILIDLEIGKLKGIGDINLTGDGFINLTFLINIYDIVCVCVC

SEQ ID NO: 24273 - protein, 125 aa, Candida albicans
VLGTEETKVENEEKKKCHEWQPLLSQHQINSTIMSDATKLDSKPSTTIPLKHTSGLTEEEKNVIKTLEEDDEFEDFPEDDSKWSSNSTNKLSEQNLWEEDWDDDDGQDEVFNKLRVLNRRCKNTC

SEQ ID NO: 24274 - protein, 121 aa, Candida albicans
NRGQLHSRNVLDYLDTTMENEENEENEENEENEENIYRRSNYITSIERGEVNAPNRNNTEHHKKKKRQQLKFFGQNTTLEERKKPEKRNSSKTHTQYIYIYINISIYICFNLTFPPFFSSF

SEQ ID NO: 24275 - protein, 70 aa, Candida albicans
KLHFIMAGVRQLRIIALTAFVLGLIFTLHKVGSNAASLVHAQASDQQPNKHNTKSTTYTATNDESVANLI

SEQ ID NO: 24276 - protein, 78 aa, Candida albicans
CFFFPFLRSNKRDILKFQLKIVPARGESGSSSEALSGLIILVFFCFCINSWWNAYHAAQKKSNLFISSLHISITTNKY

SEQ ID NO: 24277 - protein, 72 aa, Candida albicans
LVNEAFSSSMLVAIGGTVSGSEKFDKLNESNLIFKSKKNLKKGSGFGPSSPANEPLILWALNNSSGKSSHTF

SEQ ID NO: 24278 - protein, 122 aa, Candida albicans
NNAPFRLISPFVVSMFEEKNKNVKLRVNATGNLNLNVFDVRRALKASKGLSLNVNNFDKNLIEVSKRSTRLCCEYELPDPYFKESEMEEEVVLVSDYDSDDLYNGSGFDPDEEYMGIIVLSK

SEQ ID NO: 24279 - protein, 90 aa, Candida albicans
ILTLNYTVRGTTMNMFVLESVELEATKLVSTKKLDIVSVTSDPLSITNSEIKFIYEEPMEVSQVIQSHISSMHFPRGKSVQVACYNELRK

SEQ ID NO: 24280 - protein, 111 aa, Candida albicans
LCFSIRYILLGISSINLKHHQNIRTFVWLYITSPNNKCSYFCVDPLFRKSRPRTFFFLADNYTYRSILFLDCMHKSISTNSNNSSGGGCDNLIGYLFLVFFNSLYRCCNIF

SEQ ID NO: 24281 - protein, 75 aa, Candida albicans
  UNSURE (55),(56),(57),(59),(60),(62): Identity of amino acid sequences at the above locations are unknown.
SIFFVPSSSFIHKIIILIVTDKYYKDESMPMPNLSLEKAIEISGKHFNIQIGGNXXXEXXRXEFERALNLFLKKF

SEQ ID NO: 24282 - protein, 81 aa, Candida albicans
VGVGQQQQQRQQQLRRKKKAVKIPIYFFPSKPFAKFYCCPDSIQFNLIQSKVFLFFLFNISFLNQYNQPIIFSIFQYFYLL

SEQ ID NO: 24283 - protein, 66 aa, Candida albicans
IGVISRKTTEERVNKTMTSLVKTPQQHYSHRYYYSTYLNESIQLVGYCPMHPTLLGEPFSGLSFFL

SEQ ID NO: 24284 - protein, 199 aa, Candida albicans
LISKRKLWITDIHLFKSFFLLIYSSWWLAVKYLKLFFPPILNKKKSHSSNTYKKKMEEIFKLTMDEPFENSTHISSTSQILQDCLLIIESPSHDSYKSSDSNSPVSTKSNNYSDHPDILYFQKIKQKNHFKFHKSKFQAKWNIDKVNSSKMNSNFDPYDLSSLLARLKSFNSLNWKSIDDSSINELKCAINGWKCVSFG

SEQ ID NO: 24285 - protein, 347 aa, Candida albicans
  UNSURE (75): Identity of amino acid sequences at the above locations are unknown.
MDGNVYRLGKRKIKNHLLCTYCNQQLILKFESNDLHNGHSTIVDTPFDFQYLSAKTFDESFQKKLVELYTKQIGXTGHGPNCLWKNFETPIEEVYHLRQYLPNTNQFLIQEYCKNLKNLIDNTLILQEYSDTFTSEFLQLQVNNDDFIHVSNEWLMAKFFRDNKENFSAGLAYNIPSWIYQLALHGWALNVQSYARDIILVMSCNMCNQRVFLNSDHSSNHQECSTHLKLSLSKILTPVKYAMSGTQNNDNTEFDTIVESKFDPRTQHKPWCAYLHNNLPAYFYQMLVQSKTNIGPVGEYIYDSSLMDIDTSIDSNQPPTRKRKNSFTVNEGLERLSKLRKLYLIDE

SEQ ID NO: 24286 - protein, 68 aa, Candida albicans
SCRKFTQVTYLFERYLGSTIKPPYNYCFKLTILCQPQNLVSFSAVPDIIVISYRLFIDNETKRKIEAR

SEQ ID NO: 24287 - protein, 68 aa, Candida albicans
  UNSURE (36): Identity of amino acid sequences at the above locations are unknown.
GLPTAERRRRMTHVRYRLGPPDKPINAQDSDAERKXRQKLKKFTARNLMPRKAPQKKKREKKNVQAKQ

SEQ ID NO: 24288 - protein, 81 aa, Candida albicans
  UNSURE (80): Identity of amino acid sequences at the above locations are unknown.
FLFNIVKFSLLFGLSVLQFIFIINLYLNRLISLPTSSCFLLLPVDPPFLDNLSSLSLTNYSLKNYLSFNLLIVNSSHLIXN

SEQ ID NO: 24289 - protein, 86 aa, Candida albicans
  UNSURE (37): Identity of amino acid sequences at the above locations are unknown.
IGLNIILKEVKQQILSVMGTIGNFPQCICILLNYQRXMRFLHKHGRSEELYIKSHDQTQANSKLNAQPIRIDDSSDPSPTSLIIFI

SEQ ID NO: 24290 - protein, 209 aa, Candida albicans
HKSPDLSEDYFGQNSIKSPALNPENTNSAKYKTKFKPHLSKLDTTDFNRNFVDEGLKLDHDYKQLQNEEENQGLGIKSKQVNGKSDLHTVDSNKKQESTAAKKKSSLGPSFSGLSAANRTKFLNSKSYKELLENYCFFSSNTASGVDTASIGSNGQPRVNNNNGGSRNSSSSSNSSSESNNGNSSSTSGDENSKIARENSFTISSFLGT

SEQ ID NO: 24291 - protein, 63 aa, Candida albicans
AFIDDNKSFFFFFNKKSCDIHKLKIFQQTLPLSKPTSEEEEKKTTSESINNISPFSSHPLLQS

SEQ ID NO: 24292 - protein, 67 aa, Candida albicans
PMHMDLNDYDVSMKCNQKPQKTSYIHTPRISKGTSENPNLEQYPPSGHLYELPMLSSIPPSILALYK

SEQ ID NO: 24293 - protein, 77 aa, Candida albicans
RNIFISFFIYINRYYKFGIFLHFFLPSISFSFLFVKASTIYFFFEAKHKTIFIYIRLDIHSFKFHFNTHSVYRSPID

SEQ ID NO: 24294 - protein, 79 aa, Candida albicans
VSVKKSRRERECVFSLSELRRPKCTLTTWPKKKKREEERRMRVFFTKSILYFFDFVLTYTHGLKPRKIKCLQQAMAGHC

SEQ ID NO: 24295 - protein, 65 aa, Candida albicans
LVFRQLLSHYNYLGIMLTTTTTHLPITLSLHVTIIVVVGILYLERREEKGREVSASVINEMKIIV

SEQ ID NO: 24296 - protein, 76 aa, Candida albicans
LIILNNKLKTFMAVLLLSFSLFLVFFHLLSNVIYTTTEGSELKTIIFPLFASSLVVLLCVKIYQEGYDDNNFLTFV

SEQ ID NO: 24297 - protein, 66 aa, Candida albicans
LLISYCVPLLNVCSLYKYIVFMRKLVLKKSFIDRLKVNHDSESEFVSKKIFFFWVVVVLVVIVAGV

SEQ ID NO: 24298 - protein, 81 aa, Candida albicans
LHYDQSFGLLASKNTPEKENSTNFKYFADLFFSIKLCRIFSIKYTRGFKHKKVLQILTFLGFNDLYDTAIFNQAFSSNTRR

SEQ ID NO: 24299 - protein, 72 aa, Candida albicans
KSIAVPLIVLGIFTEFKVTVSALFFTPFESGDALNTLDVSTFVVGDEIGQDNLSSYFPLSLIKLFTDFLSSL

SEQ ID NO: 24300 - protein, 94 aa, Candida albicans
QEESDNTWKLKNRKKKGTTKNLKKVYRFYFMQFFFWGDYVYLMIYYILYYWINYSVRVAKIVYIICDYAIGKGGKKKLQKKKPKKKNKKKLIIQ

SEQ ID NO: 24301 - protein, 79 aa, Candida albicans
ISTTLYPRILVCFNLLSQITKLKKNILKSYFIKLCTKSRPFFFLYLTHVNILIYLVMEKLQGTVKCTLSSSSMNLLMAL

SEQ ID NO: 24302 - protein, 208 aa, Candida albicans
NINNFHHHVIASAYLLNQVLTPQNIEFEIIPSNNTNLSDINQLPVLIDNETKEKYNGYNEIIRFIESKYFSTSTKLSLVSYLPSDSLKTTKEKLINKGLINLLINKFEYINQYNLYLNNKNYENYTRKLFSSYLPFPMMYNQPSKYYAQAQEQVKILGLSKQKVSFFDFTTGNNEQGSIDVAPTELINDEDDEEGDEDEDGANVAISS

SEQ ID NO: 24303 - protein, 70 aa, Candida albicans
HERQLLKKSKSKQVLKESRNSMKCLILITQYIERFKTIFQHQQRDSDEEFGFIFDNQIFTTGLTGTALKV

SEQ ID NO: 24304 - protein, 82 aa, Candida albicans
  UNSURE (54): Identity of amino acid sequences at the above locations are unknown.
QSDKYTTSFLTLLHRVKHFHPIAVPKMSSYEFPIVLVKNLPYNTSNSSLYEFFXQIWLHKSNSNKLITTRNLFYNLPGLFTR

SEQ ID NO: 24305 - protein, 75 aa, Candida albicans
TIVGLFGICFVLFVEFEMVVSYSVLMRLIKLCKKIVVKENRFSKNPSARKLLKNLLRQIILYGKNYFRTLRKLQN

SEQ ID NO: 24306 - protein, 90 aa, Candida albicans
TIKWELPSSQSRVLSFNNQSKVTTIWPNPERHLPKASTWNQIQTSINAASKLDKIEPYAQNNELSWIGNSGYKSIIHSTKVVLINLQQFA

SEQ ID NO: 24307 - protein, 229 aa, Candida albicans
LIINTMSTATALETTNAEKKFVNTYLELMQLSKNESLDKFNSTQDYNNLSSLGPSLPKCNYKFPEPQNVTKAAESTVTLKFKSIKPPFKFQTELSNIPVNFTIYKVKAQLIESLEILHNAGVTAKDLKLMIKSKVAQDAAALSSLVNTEEPISFNCMVSAPSGGKPAAATSKTDEGDPELEAVSDPVSTTATTSSISEAGWNKIYEIILQDIKDAGKAKELLAKLKQSV

SEQ ID NO: 24308 - protein, 62 aa, Candida albicans
RLDIHTAVDYLNAYWTGEEGKKKRIISSAVAVAVAAAATIAPPFFFSACISLPSRPQQKYMN

SEQ ID NO: 24309 - protein, 70 aa, Candida albicans
RSCYFLQRSSKRFCLSLNEKRKIWMKNYYSKFKRILATFKKNISKYKKVINEIEMKLIVILHLVTSKYNL

SEQ ID NO: 24310 - protein, 68 aa, Candida albicans
FNCWLLLLLLMRKKGKAIYLRVRDRKRDRDRKKIFPSFLFYSCICVQRKKFLTKYLMFQFIKQFLLLL

SEQ ID NO: 24311 - protein, 87 aa, Candida albicans
FLIVARQTKQKRDTFTHSRHTRTHDNPSPPFRLIDKYRERERDRVNANYYYFTYFLLLTTYYFTYLLTYWQNKRKFFFPTNYNQLQP

SEQ ID NO: 24312 - protein, 95 aa, Candida albicans
SLRMRMRMRREEPKKTKLKENNETRPKKKERFRINKSPTSNLEAILNLEKKKNKLKGRIPSLCSAIISLRNVFDKPSDEFDRGCMFVYYNFYFYI

SEQ ID NO: 24313 - protein, 107 aa, Candida albicans
IKNDANTDNRFPFPVQLTLHQHHLQVMRYLNDNGILQDKAPLPQFREFPEQSLILSALFLHKADIKVLTYRTIPRKNFLNWVRETSGFNRSKKFQSPEMNPISQQSL

SEQ ID NO: 24314 - protein, 65 aa, Candida albicans
EQRNLVDPRDQKFISCPPPPPPSHFSTFSFFFKLNRYLNLVNVKILEGYLLKLNLVEILKLFIGN

SEQ ID NO: 24315 - protein, 65 aa, Candida albicans
LPMNSFKISTKFSLSKYPSKIFTFTKFKYLFNLKKKEKVEKWEGGGGGGQEINFWSLGSTRFLCS

SEQ ID NO: 24316 - protein, 60 aa, Candida albicans
  UNSURE (2),(18): Identity of amino acid sequences at the above locations are unknown.
TXEKKGNMRFIRSPKLFXGPSIKKFNSRTEKYRIQLRQIFIFGMLKNFTREREIINSTII

SEQ ID NO: 24317 - protein, 185 aa, Candida albicans
FKLAMSALKLAVPEVPKAPELIPVFTFNLKLASDPASIYVNNESDKTLNLATIANGEVKTVPNKLGLELDIHSIYGTDDLNIKNSVSTASLDCKLYGKTANGSGVFIYYPGKVQLDETSISVFTKKTKEAAIEDSYVTCNPTFYFDDKVEDKYKWVLKENFFARGRFGRDEDDVLYVQYYVYVVR

SEQ ID NO: 24318 - protein, 70 aa, Candida albicans
RRLTVFHWSAILDLDFIEDPHFYVICRVINNRLKKKILEKKTQTINYLWCRLSKGVLHFSIYVIIIYLCV

SEQ ID NO: 24319 - protein, 82 aa, Candida albicans
TFLTSFLGKILTKNKENMKYDLLIEPTYKKINIPLLENYFFTIFYQYRFPSNFFIRSFNSNNFQRFLSRDHTYTFSTLVTGF

SEQ ID NO: 24320 - protein, 67 aa, Candida albicans
KTAGIRTQVPVIKCWCIANQAIRGNKETPKKVYSRDLVLVLLLHQEVILTNYGNNRLVFQMVIKLYR

SEQ ID NO: 24321 - protein, 77 aa, Candida albicans
  UNSURE (18): Identity of amino acid sequences at the above locations are unknown.
RKPFSRLGYSRGRFHSIXVPMFRIKGFKGLVGIKWGNYSTGGFYKGRKKPPTTVEINLPTNINRGWVIGTIISSGGC

SEQ ID NO: 24322 - protein, 63 aa, Candida albicans
YTTRTFYVLSANYTQQFFTLYALIFYTFSSKYYLNYKYNYLNIYSLLHCLNWVMVLIKSSPCC

SEQ ID NO: 24323 - protein, 220 aa, Candida albicans
YQEINWSPQYRFTSFSTIIMYDTAQYDKYQLTPQFIYIQQLLRYISLKHGMKIVSLRNMVDALTIGNIEQLLLTLDSISPIPILDSKGVEIAVQTNDIDRTESNGHEASHNKSQINLYIPYTWDSWNKIVVQGKSIVLPNTDEIIIRNESRLEELDSNYEKSLSRESKNNVNGGTIVDLLLPQDYLQTRNKNKPKIELLPNSTYSLSDMLREIVQPSVLE

SEQ ID NO: 24324 - protein, 73 aa, Candida albicans
KISRMRPFITTLVVQVFTPKQVAYTFYASNSIASFMTPIIALVWILSLPPFEIPYSISLKPFKISNLVFGFNL

SEQ ID NO: 24325 - protein, 73 aa, Candida albicans
ICGKNYNTSIKLYYNKTVTNSILVNSYKILTDLRRTLEEVSKNIQTLGVLLSKSYSRLVFSKTLYKTTLNHVT

SEQ ID NO: 24326 - protein, 62 aa, Candida albicans
VGCATMVVYCWPNGVSKSENMADCNRRKDIMTNASCFLSSTMSDVNRLVDTIINLSLNYKLE

SEQ ID NO: 24327 - protein, 80 aa, Candida albicans
MFPVSLNSVSNSRGLTNLGKHMFRFEENKFSSTNSTNTTLLNHQRLVCTVGELLRTIHTSEYWVVPGIKVYTEAQGLPKH

SEQ ID NO: 24328 - protein, 67 aa, Candida albicans
KHKQSRLITHSFKSTFLSENNNNDFQFSICNDPIYLYFPFNSIYLTIAACALLYIDNRWHISDVYVQ

SEQ ID NO: 24329 - protein, 60 aa, Candida albicans
AFLTHSGSSSSLSLSYTSSTSLFVSRNVLFLLKVRNHVIDEHIIDKVLPVPVGLSNSPIL

SEQ ID NO: 24330 - protein, 221 aa, Candida albicans
KKWRFDSNQNRTKKIHVTFQPKISTIAFQQVEKRQQQQQLQQQQQQPIYIHHSIRPTMSLINPIKVKRVNLAYSQNSPIEWSDNLQLSLNLYTDLTVLDPKLPDYHLIITDKDDKTVLDAKELFSETILLHNESISLLPLGRFNKIIITDTDEGLNLVASEPNIVLQQWTPNCETTRDNLLGVLFNSGELLILSRKNVQLLNYVIRINVFNILVEKYNIQC

SEQ ID NO: 24331 - protein, 79 aa, Candida albicans
LLSNRHFFYNYPHMYLFLYPLKLSSRLKVVLFLRAGEFNLISYFSQFFTKILIIYIRKNKQLYMVIRTIYSSNLLFYFY

SEQ ID NO: 24332 - protein, 63 aa, Candida albicans
KLVKCFATFSCHLFPHNQGLSFVTFSKISLDGWRGGKFSILTNRSYGRYMILSCIFQIILSDT

SEQ ID NO: 24333 - protein, 85 aa, Candida albicans
NSHNNKDILQKITTITMFTTLLSSTVRSNQLKPLTSTLSTTIPSITSIPTVSYLSPSPINYKTITSTRTKENVHELTTFLNLNWS

SEQ ID NO: 24334 - protein, 66 aa, Candida albicans
LKFSSTTSAPNEKIWVLNPRTKKHFYLPWKTLIPLMNLETHNEEHLIWVKKQQTGGETKRLKFVIG

SEQ ID NO: 24335 - protein, 62 aa, Candida albicans
YKIKGNYLVSEQPYNLSYRYKVRAIYTIIPEIHPNQNDKSTPGSFLFFVLKHFIILIITLVD

SEQ ID NO: 24336 - protein, 86 aa, Candida albicans
IRSIKAIVVSGNGNDCESFLYTLCHFNHNYNNNLLILLSLRCQQDINDAINLNTTYYYTITVTNEYSWLILKRVLLLNNKHSYSSY

SEQ ID NO: 24337 - protein, 84 aa, Candida albicans
  UNSURE (40): Identity of amino acid sequences at the above locations are unknown.
EMFKIGSFADVEVVEVLEVFMADLDKDDNAEAAVVMGALXLLLLVAVPVVVVVVVVEEIFDEFSSTGSVPLSRVLVEVEDFLFV

SEQ ID NO: 24338 - protein, 67 aa, Candida albicans
TLNLNNNLTMMCVLWENWGRNCGLQKFLFSSLNDSSKYQLSLNYLKQFNHHYELAYPILVLLVSNEY

SEQ ID NO: 24339 - protein, 85 aa, Candida albicans
LIESNGNTLNSYLPNWVILKITNQRELANRNEVLYIITNYNFVNLLLREQGRGGRGGLYSYSIKRVTFYVHFLYVFTTRLEGPEL

SEQ ID NO: 24340 - protein, 85 aa, Candida albicans
PITSKIVPQAKQIVKYFVFVENPMPKRQINVTPNMAAKNALNGTERLIAYKLAFHSNCFKLNVAFTIADVTSGKSCVAVAVAKYC

SEQ ID NO: 24341 - protein, 106 aa, Candida albicans
ITVRKRKSLSCSRYFKFMIKKSVEPVTLANYNKPKAKNCHVNVVRPLLIVKFCQNSIYGVYNFNKNCEKNVTKNILTATRYHHSLDITYKYLLNLATLLVYTCKVY

SEQ ID NO: 24342 - protein, 85 aa, Candida albicans
YFELALAYSTRGLNEVIDDNIVLAYYLRMIIPSPMVSLFEIQKVKYFSPTFFFSVFSAFSFWSHPITTLQVINCSGLQPNTRLVF

SEQ ID NO: 24343 - protein, 68 aa, Candida albicans
MVQLPSPQSEHNQQMPDAIPKLETDYNGLTKNLKEANELLLNSNNKQPTQFPIKNVLSAKKHHQHKQY

SEQ ID NO: 24344 - protein, 87 aa, Candida albicans
HLQSNFQSVIELLFLCDLFCNSSLQLREVWMDFSIHHNLINSPDRLSCVSMSIRIVSTFDYIIHLYQYIYLLLNIKQIMATSYLSFL

SEQ ID NO: 24345 - protein, 97 aa, Candida albicans
EGKKKSQDLTTFVIFFFNYTLLSIVTMIPKVNRWKIGLISGAVVVGAGYLILKTFPHIFAKEEDDDESDNVVVHREVDENPNKPIELFESEETFEKS

SEQ ID NO: 24346 - protein, 70 aa, Candida albicans
VAPKKIVALKQTIITKIPQIAKNNPPYLQNFCKLFNEVLPSIGLINKYPNNPGNINEIDVEPVEPTNAKT

SEQ ID NO: 24347 - protein, 65 aa, Candida albicans
SPQHYSFTCLWPNTQFGSVSFINVTQLEFMQTTLNMGIFLRIIQNDAIEEKARISFRNLQKGYVF

SEQ ID NO: 24348 - protein, 98 aa, Candida albicans
FNRSDLRADLYVAILSDFLPDITVMISGSSSSEESDSNEIIDTLSGIYGIVGGSLTLKVFDKEVKCLSRKSLRSRSPNNFFFWFHLPRRVYQFFSSPP

SEQ ID NO: 24349 - protein, 561 aa, Candida albicans
NQKKKLLGDLLLKDFLLKHLTSLSNTFKVRLPPTMPYMPDNVSIISLLSDSSDDEDPDIMTVISGKKSDRIATYKSARRSLRLNYINNNNTITKNTYSQQPFDSKKPFDIKIPSVFKYEANKIHKINTRNENIKQEINKEEQELKEKYEKLQQIKARLVMELNDNGSDGLLKYDANENSLYIDSLIRQEINDMDKVRRNFYFLKNVEEMIFDFGGNFDYIPQSLLFLIARDPITAYNTSTIIKSDLRKFIMRALSTVLNPQHLISIIEMIKNIEQNVFTFDELVDFTNKFGGETKLLHENKMPLKINMFNNHLRMQLLRLTLLFNGYLIGDNDEQNLAGFLKLFFYIVSDYNANKREYTTLEYFTVSIFTQLVKKYHKPDNNEFVLLLFKYISGIETSNYGNAQETDTTKSFELCFNFVRLLNVAFTRNNDTNITDIIYKLNIILISNASSLDRSIPEVVNELVSYIKLTDIDLKFCYKIKALIFILNGNYMVNQTRDTLNQIKEDIMELKKIFYSSMKKLTTATENLDLVMMVQDAFHQLEYLNNMIESFQHEDLFYNDI

SEQ ID NO: 24350 - protein, 166 aa, Candida albicans
ILATMSQTTTRPRRKATINKSYNDSVDLNSLDYDSLNSVSTANSTQLSGSTTSGSRRKNQTSTSSGNNGRKTSAETNKSTTNGNNINNSTNGNLALLNLPNNWQSSPRLEDYFSFKLDLSDAYIDIDSQTLFCPNQFPTNNTNLNSRRKNNVAPFSLIFTSRTRIS

SEQ ID NO: 24351 - protein, 67 aa, Candida albicans
HADIPFRGQEAYSIWCWRMCIKWVDLYHKCSITIADILPFLAEQSVSLFFEKLQVASASNTSAYRMK

SEQ ID NO: 24352 - protein, 65 aa, Candida albicans
KILSQFRRLINNKVRIRDEVVFALSRLSSKNIKGRESNRTGKRLASHFFFSLFQFWKTDYLLSCI

SEQ ID NO: 24353 - protein, 82 aa, Candida albicans
RSHLLTVIHILCISAVPLYSSRSFWQFPFVVFLRTEHYHTNTFIYWLYQIVESALGINEDQLNTIGNVFKKKICRSQYYRKF

SEQ ID NO: 24354 - protein, 102 aa, Candida albicans
YFPMYNCQKYPHKTILQKIKHNHNNSNNNNNPEYWHVFFNEAFLNFYFILYADVLLAEATCNFSKNKETLCSAKNGNMSAIVIEHLWYKSTHLIHIRQHHIE

SEQ ID NO: 24355 - protein, 68 aa, Candida albicans
LFLALHRTPASISLNSLIRGTNSSELVDFKLDLDLGNKSDLLAHNIMGKLTPMDRNNGIQCNEIRSYV

SEQ ID NO: 24356 - protein, 67 aa, Candida albicans
VNTKGINGIDTLKKKKNNILHEFAWPCVFICNFCVPNKKKDGMVQSYILHEISISTLLRKRNTICVY

SEQ ID NO: 24357 - protein, 69 aa, Candida albicans
NAFLILKEKRGTNQLLIGGQAFYPLPSLPSLGNGSGHHPHGFNIPSINPASDQIQMGQVCILKPAFGVI

SEQ ID NO: 24358 - protein, 86 aa, Candida albicans
QHLWIELLQVNNHNQTQPHLVWSSYLINWSNINLLLFTSKQASEAGYLFFFLINHNSEFLKYFKKATDTVLNTNHIFNLLPRSKRF

SEQ ID NO: 24359 - protein, 89 aa, Candida albicans
IQITFSISSPVQKDFERVLMSNHQEPWNNQQRPLGQPFKYVSIFCIVNPHRFVWYTDIILFFFSRQHPPVLPPPATLEQGMFLKCLFNT

SEQ ID NO: 24360 - protein, 75 aa, Candida albicans
NFIFISRKKAKKKKKFKQRTKTITMKGRKGWANRISGKAKKKKKRSNTKGIVNYRFDQPIIAIPDTTHLLRHTMG

SEQ ID NO: 24361 - protein, 60 aa, Candida albicans
QYLTLPTYYAIRWDKLCVIFAQCYCLRVKIFKIISQYIKQLQHNCGDSIFIKALFLYFSI

SEQ ID NO: 24362 - protein, 60 aa, Candida albicans
CNESDDGTKKKFVKLAIIIQIGPHPFCLALFVKLFNHITICNLLLLLILISSTTSLHAVV

SEQ ID NO: 24363 - protein, 624 aa, Candida albicans
PLVDLFPTFLPQTFWEKKKKKKKKKKKIIMTTNGTNGFDFADKGDHPPRQSQENPPGNFQELPLDGGQIRKSSSNDGVSNNVEFNTNTNAHESWADYPESDQMDTDSSEYYTEDENEEGKIPKGPYHQFQNANKFTYFTPETATTLVAPNNNTQNTTTEQDNMSKTYASVAATFKTNLAKSQDKQEELRMSNFKVPQKAFDDLKRHNDAVFPEEVMTSDLSTIINKYGHEKVLDTIENTLITTAQNLEGYLSEYPENVMRKAFKYFTLKLSIEDKQTRDVCEEILGIREELMYIQRILDFNIMDKVMCFMPFTFEQMEGKLSSEKAKVRTIVENLELDFDGTVEHIKIDSAKRNRQLVAFKVPIHCRSLAERYFRQIFLHKEDVIVQQYAPIIEKVQLGRKGKTEENNHQLLTEYVCYFIVDLFSGQVPKRRIKIDNTKNKPSSYEQCTSRVLSNCKYCEYCRSMTHTKYHCPLIKPCTNCGVKGHKTTSCKKALSTNTLVLKRPETKPNFPILPPKVVNKTTSDDSQRKGSIAKTTSHTKGDNTEKMVTPSAQNENTTLQESIPVTITGHREAPTTPPVADTTAKKTMTTGVLEMDTSKHTISSNDEASPKEKIKCEGKAQQS

SEQ ID NO: 24364 - protein, 60 aa, Candida albicans
ELLHVCFSLLKIDFPVIYNTKTKTDKNTRKKKKKKKRKTTNSYSYIHTYTHYLITVNEEK

SEQ ID NO: 24365 - protein, 91 aa, Candida albicans
  UNSURE (86): Identity of amino acid sequences at the above locations are unknown.
MKRNESYINSLTIGSKNIGSHQSTDFKKLLDIFLKLIGEHLMIDIWFIQEIRFVSQEQFNYINKILKQHNAQLRMHHFEDLTGFLXHSPHA

SEQ ID NO: 24366 - protein, 184 aa, Candida albicans
ASFKRYSWFNSQESLSIKGKLQVKECDPTDDNDKYNTSLDQDLLDEINQIPDDFDFDQKPPETEKYKRLSQERSGFYRYNSYNRKPKKTVISNQFLSNKIETLNKTVTFYKSSSPSSSIFDYRSRSVSRGHYTRYMNSFASVSEEVNEEDENLEENEGGGDENYSELIKEVNGDYSFRFQVIPS

SEQ ID NO: 24367 - protein, 66 aa, Candida albicans
RILYLSHTQLLSFLLFFFFFLSQDKGRDQTNQIAFSLCVYGNFILLLCLVFQLEIKYQQPYFIVLN

SEQ ID NO: 24368 - protein, 64 aa, Candida albicans
RLGFVVVSADDGVVFVVADVWMPGFSLLVVFVDILVVVGVALDEGEDGEGEGDSVLDRLLSIFE

SEQ ID NO: 24369 - protein, 74 aa, Candida albicans
  UNSURE (34): Identity of amino acid sequences at the above locations are unknown.
KVFRSSNKDWNFSNKFKNEEIIFTLEYIRPTLGXALHGRPTMRHLIDIEHWHPHSSASRTLLNGFPLTSVDYEL

SEQ ID NO: 24370 - protein, 88 aa, Candida albicans
NLGCREYRKAATTPLSLLCLYVSMPPHHQIRHMTQKHSTGQLSLLLLKIVGSNYYKTILSFACAIIVLLNQYFHSAFLHVNAPFVKDR

SEQ ID NO: 24371 - protein, 90 aa, Candida albicans
RFQSCQLLSAAVTIVHFLCFCWVLVSLVFLVNLLNVLKIEVIFILSKRDDVKLENSPAIYTNYHNHYIESAVKGLDLNLTSTQRRMIYEI

SEQ ID NO: 24372 - protein, 78 aa, Candida albicans
KIWGFISFWYISSEINSHQNKILSGIDHFCIWDFYRGGLYGHSKFSKLSGGSSMRIIIQIVHTKQSKDPGCLSTQIQL

SEQ ID NO: 24373 - protein, 72 aa, Candida albicans
LKISVILLISLYATTTRSQNVVIFQSPFKSCSLTPCGITITNDSMCNLNYKLIILLITYESSTLVKATTTYK

SEQ ID NO: 24374 - protein, 88 aa, Candida albicans
INFTRNIPKTNKTPNFLLNNQLISKTQTKTLMPDGYFYGKPFIITSRTLNGRQPFYTICYANGKCENVTEDTIRHHAPQAVRKYRLRN

SEQ ID NO: 24375 - protein, 62 aa, Candida albicans
HTMSDGYMNGMRFNIATCTTRSGVFYYVICYENGMQETMSEAKLRYYDPQSISKFNKRINKK

SEQ ID NO: 24376 - protein, 155 aa, Candida albicans
LFWPIQWVVSIAYLLGWHYLDRGFNNLTLVTKGQPLLGNENFVSWGDKVLASVNEATHNEFKRTFLRVIHKNDVITTLPRDQNIFNRYSQFNNQIYLNCSETDTRPTINEVIDCYDGSNNQCIAKDFPFLMFERRNYLQIHINYFRQMGLCGILN

SEQ ID NO: 24377 - protein, 160 aa, Candida albicans
QMYLGLVLSLFVSQILHLISAHPINDDNSIFIDNRDPTTPIDSEIYSNLYTYAHLIDISYCISEVNRIEEPFKCNLNCEKRFPNISLVYQFYFDDSVTGYIAKTTSNIFIYNETIAEDKKTIIVALRGTRSIFDTLTDLKVDMIPYSNTGTKLPLCGFEC

SEQ ID NO: 24378 - protein, 116 aa, Candida albicans
NMAQVIWNSHIDVYNKDVIPINIAKNIAKYLPIQDILSFSQVSKNCHLAVTDPKLWVSMLKGMGVWQEAKLLTKQDIKSNQKSNTPGGYLNDPLTCMDYIYRSNKNAKYQVIKIYR

SEQ ID NO: 24379 - protein, 89 aa, Candida albicans
PCLVVLPLLNIIIGFSIPIQNWSNLVVGIFIQLYLDATVFFCFRKRTLSYEFVGRMGLIFATIIIRLFVSLFYFNIALKGDTFILRSIL

SEQ ID NO: 24380 - protein, 65 aa, Candida albicans
NQNYTEIGSFTDTNLRNQLTLQIEITYSYVFFPNKEMRFLKIWFKSVFRVQISQLNSRVWSYCRC

SEQ ID NO: 24381 - protein, 64 aa, Candida albicans
QLRKGVSRRSQASSVLDAGHVVGLRVICLNRKYVNNKNQFFFFRDSEQKKEFPSQPKNSNNNKQ

SEQ ID NO: 24382 - protein, 63 aa, Candida albicans
KQRENTKQAKFTLKSSLNWPQKVNKACHSVITNHRILLAARRTRKFEISSHYGSKKEQNFKGL

SEQ ID NO: 24383 - protein, 81 aa, Candida albicans
YVVVVVNENVRTNRPTDRPKVLTNQQKKKNVSKEQCNGKMEKLYPTYIYNQLFISPPSPPSQKNLLSFLSFPFLLLLSFLY

SEQ ID NO: 24384 - protein, 65 aa, Candida albicans
KLTKAEQTKTTDQYEVKQRKHSTKNQTRKRSHFLRVWSNMKALQDITEQGMSYFKYCRRTRTEQI

SEQ ID NO: 24385 - protein, 154 aa, Candida albicans
KQYLNFTPTSFEQPQPFTPIHSKYKNIEEPIKRFLSFSFPSTFFPYVSISQFMKTLLIFLAFLSSIFASLIGLTPPSKDSFYSPPVGFASAKPGDILEIRNTPSAPSSLYLPIVVKNAWQLLIRSEDLLEIQMLLLLVLHPRALENPQIALGHT

SEQ ID NO: 24386 - protein, 66 aa, Candida albicans
SFFFYDYDEITLSKKYNVQAQWEEGNLSLFDELSLNFVRTNFLNYINTFIYLSIYWLMLYTIIQSF

SEQ ID NO: 24387 - protein, 557 aa, Candida albicans
  UNSURE (253): Identity of amino acid sequences at the above locations are unknown.
YLLTIAFPFRQRNVQTSQLNINQKPTTSSAQSTTDRKIKKDSRIRGSGSRNVKANHLNIDPSENKRLVSQLSSALTKDGDLELSRSSRRKSSILPYKIIERPKISRKSTTKRVSFKEKSQPRPQQEEAKIEVDSISNLQDFNDEENLEYSQSNITEDSLIPSFQPQIGKLKRKKPSSGKKSKIALDNNSNLPSESILKNTNKLNSNISKAKSKIDTLQSRPIKRHTVSKTALADSPRSSIMETSLFGDTESEXSIAHDNTKNTLKALKKVPSRSKKSSNSVESSLISESITKQKESVQPSPTIPKESSVETILSEESEDDTDDNESDNEIKHDDNAYDPDYGRPIISRRKGKGKGKGLPIISSRRKRALPLFDNNANHGNGKTRKTLTIDYPSLVNAANTRGRVQRARMLDVLRYLVSSFDPEVPDNRLHLHQRFQKHLLSSIDNVRDAATSVEDVAKNIASVQKAKKQLRQMILDLRKDHTDIGNQLNELRLQVTNKKLETERLDVIYNQLREVKAYTENPNNNISTKGNLSYTVHMVLASLQKNCQSYFGDYSYT

SEQ ID NO: 24388 - protein, 76 aa, Candida albicans
PLLLIQSIALVVESERLVSVLQCKDSDNTTTYQACPNRDNDLFNQFGTKVAISGKPAHAQFHKLLSHSFIFSHDII

SEQ ID NO: 24389 - protein, 141 aa, Candida albicans
FFFSGAYFQFLFFPPHIQYPYCINYTNSLLVMVGRIGTKPKKKKTLPKSTPPTKQHLMEYTRSVRISIIFRKNDMLSWYTNLQNACLDSPTSFSTIQFGCSNYILYSIELNGYFIFDCQCYISTTVSYNKRYYVMNFKVYS

SEQ ID NO: 24390 - protein, 417 aa, Candida albicans
FTVFFVFIISIIIPYKFFKVSNNMTSLRKASFFERYQICRTENKYYLNFNITVEYPFPITKAKLSRALSHLIKDNPILGCNFFGSTDNDYRDYVLKSIPITFDSVVEYTEYDVNPEFFEFLNTIYFEMNCTKPLWKLFIKDSRITICCNHAYFDGNGEAFFHKELFRLLLDTSDDVEFQNVLSKEVDSLSESVTEVCSLYKTPIWFLIRGALQLWLPNWMRKLVAYFTYPNINKYPMFQNKPISLNQHTNFSVINLNNDIVSKMLAITRSTSTKLTPWLITIALQTFQEFHPNRSMSIAIPLNGTRYYDLDMFQVAVAESSIDIEPITNPIATTNYITKRLQRDLDSRHPFYFVGLLKYINIGEISRFLKSKIGTHKRSTMEISNVGKMPLPCWCSRNNGFLSHLQFNVVSSPQGMN

SEQ ID NO: 24391 - protein, 69 aa, Candida albicans
SVVSDLLVIIRLRYFFKLKALVSEINDIVIAAMSEKFVLSLLFSSLLSKIFHHFKGCFFLVAILMRNFY

SEQ ID NO: 24392 - protein, 71 aa, Candida albicans
DSLCALRREAKEREQEEEQVDSHCSIDTHYLQQQQQQHQRQKKNLRTFNISDEIFLFFCSSWKFLLLLLES

SEQ ID NO: 24393 - protein, 80 aa, Candida albicans
VKRPDQSNNYNVMPTEITAHRYILIYASSPPPPPLSLSLSLPLPTCQIYFSTSIILKYGFLFLRAPIQIFFILLIAINRF

SEQ ID NO: 24394 - protein, 69 aa, Candida albicans
IFLFIRVLLFNKHTKEEEYKKVKSHYINNKHYLSIYLAAAVPVVDWNIGAFGTPEAFFKSWFDCCEVCP

SEQ ID NO: 24395 - protein, 62 aa, Candida albicans
ILVVKKTNLGSKFPIRKKYANNFKKKQRKETRQLKYPENEKKREWEEEQKKNNNVCVCVRDE

SEQ ID NO: 24396 - protein, 68 aa, Candida albicans
RSIIMDIPLKSKPKVSTVNLLADSKFEIGSTTNSSAPLDIDNNDKDEPSQLNPNYLSSTTGLEGSAIG

SEQ ID NO: 24397 - protein, 69 aa, Candida albicans
  UNSURE (4),(5),(15): Identity of amino acid sequences at the above locations are unknown.
EFQXXSLVGNLLKLXRYLSEISTLKEVRERKKKNNQNLPTNTNSYNHFYNHIFNSNIHIYTHTHNVISC

SEQ ID NO: 24398 - protein, 169 aa, Candida albicans
INIIINLLDLNNSINQTSLHPQIQGNNQPYGKTGKNTKTNIQFNNDDNDDDSTKTHGYYNLLLTLVKKINRKYNCLVVLTSYDIEFDSGLVGSYLYNPNHELQRYTKLPIPFITRFTSTIHISNDANVIHVLNNSTTATAATYPTSDKIEQNKRKHISHPKWQMISKNL

SEQ ID NO: 24399 - protein, 79 aa, Candida albicans
  UNSURE (9),(10),(17): Identity of amino acid sequences at the above locations are unknown.
VLINFQPMXXVETLTHXIFPFFYPFLHDIDFITATTNTTVSRDTILLYPPGPFYSSSSRGRPRPRPRPRCCLQISLISA

SEQ ID NO: 24400 - protein, 177 aa, Candida albicans
  UNSURE (5): Identity of amino acid sequences at the above locations are unknown.
PPTPXIFMKQSKLLDYHVSKSTKIELRLFENTLNFSNNDYGLILYPNRKTFRQHILPQLNNNNNNTNATDSILVISCMDNELLRNNFINFVPCKNYPQLIKILQDLYNCNENSPYFDNATTTTTTTIQILDKHINYILIHNISSFFYDLQIVDQYNYQSLGFEQFNQPDKSPPPDTR

SEQ ID NO: 24401 - protein, 72 aa, Candida albicans
KNTTRHDTRYTRNATKKWRGRGRKEGVDDKLQILIIAFKKNATYVFIGPMIENGTAQNEKRSIKYNPTPYRS

SEQ ID NO: 24402 - protein, 73 aa, Candida albicans
PAPNSSLDPAACRLRQKNDVREVELLVVIMTREDEYWEYIDYDDNDDEYYGYSDDGDSDGYIEEIYQVISENK

SEQ ID NO: 24403 - protein, 113 aa, Candida albicans
SRGTISTPPLYPPASFSWISSLIFSMRIRAFFLKDFGSRLIIPPQISDTVVAIVWYVLLNTNSKKSSRNYLNKSSEIDSNMMYKNFGNETARALSKPMLISGSGKFSKSKVNR

SEQ ID NO: 24404 - protein, 63 aa, Candida albicans
INNRIIIDMSYTSTNTLIDCSSCKDYHNNLRDISLASVVVPPWDNSDVSIYFLLVSISPEYAI

SEQ ID NO: 24405 - protein, 83 aa, Candida albicans
RSWFLPPPCVKTYPGITTTDSELTDKLINNDELSKSLKESLLIDNRLAKIPLPEKVIDAGIFLKRESRLADEDDFDDYHSKGW

SEQ ID NO: 24406 - protein, 66 aa, Candida albicans
SRPGVVFPAGTRETGLAPEHNGTHLETKKYNKEKVKNQLHTNFTTYTLLFILFSLIYECQLKEKTI

SEQ ID NO: 24407 - protein, 327 aa, Candida albicans
VGPCGSPGVVKMEVKKNPIYQEVVQIVESLGLDSFKLEVPEESSSNKTTTETTTKAEPIVTTPTTAKRVSSTPVPKLTKTERRLSLDLMHPRPSFGLNQESQLVKPPIASTTNIHVHAQQETASHFNPSVRQPSKKKFTFHKSKFTISTNRQQQQQQQTNTAPRQRRTSTVDEQLPLYIRNLLTKNRPRQTITPKPSKHHFIQNASPANSSPRGSYKRSSRIQNLLTNSQSLYVHSKDPANSAETSTPTSNDTDLQLRYYSDELDDEDNREYILPDLLTRYFGVHEDHEIEEDTDEDADDDSEEEEEEEENDFVNVGDDHDDYLFKI

SEQ ID NO: 24408 - protein, 68 aa, Candida albicans
IVSHSITLIFLMNDNEYSYMNNEIALVGAVFNTLIPKPLYKPKTPSFFSMVTNICRAVYGLPWTTEHI

SEQ ID NO: 24409 - protein, 63 aa, Candida albicans
YHLPFITSTSPRAMIMDIQKHPLIPRHAFITLRNNFNAIDNVLSLHYTNHTSNPTSPREEDPR

SEQ ID NO: 24410 - protein, 174 aa, Candida albicans
SNQDHQPNNYTTMDSVEIDQINNIEKEIDEIKADIALIEKDLTSNQLQKQQLQEEIEALVLEQQKQAQDKTKESPVPSGPDDMDIEIPEIIKHNYFDPSIQKYFQQSTSPSNQLSLPENATTKIASSQLKPINDLELKENVLYENIFRNVWYNCIPDELNTCFDERPESRFSGR

SEQ ID NO: 24411 - protein, 318 aa, Candida albicans
RLKDPMNVIIFVKNWLLEISDSIIPFVIFDSLMNLYNQENVAAADLIKLLSTIPRSNLASLIYVIEYFGNLFALGSIPNYEISDELPEESLLESIEEASIVQVSNELNSMDTIGSIPIMHLILRPSTSKNSTGFKPPLDKYKRIMVDILKLDVRTELLKHLIEHEINYKSKKEAEKLQVKKIPVPVPVPVPVSESESPQTPPQAKVDSIDRSTPAIVHPQPTQPNKQKRPESAEFTLRPFRTRPTPVPSPQSSPKRGAFPTFTGSLSSGASTTKLPTPPLSQPTTTNQLLPPASHHTNRGRTLSNSFITPRIEIEFEN

SEQ ID NO: 24412 - protein, 70 aa, Candida albicans
YNYYLWPLIIKLVIGTFSTFFNFLTLNKNIPPTPFVKPHFYTSNTPFISLIKSLISIHLWRNHIIPPPSS

SEQ ID NO: 24413 - protein, 93 aa, Candida albicans
  UNSURE (10),(46): Identity of amino acid sequences at the above locations are unknown.
LSMGSIPYIXNQTIKIIEERSHDIFEVFRKLWMQPIEYQVQWRIKXDIIQLVADYTPDLKTIFSNKYLIEQEFSNQVLKHLKAQRPNERDNIC

SEQ ID NO: 24414 - protein, 256 aa, Candida albicans
YSNPLESMLSKSRSYVSIACDNCRKRRRKCNGELPCHYCSGKNKPCVYDKTKDKRRRRVDLVYVDYLEHKYNNLLNFVKRIRSTTKDERLRAQCNEMLANNDPKFIDNKDLGLSNDELTHNNQSDKQQKEIIQLDNPMDELVSMKWELKFDESGNTKFLGPPVRQVDRCLVKDSMVGMEEPDRVSYFNETVLADTEFMKELISTFFQNLLPFNLVLEEINVDEITREITSMTDKRRVLRSSEWLTFISIGYFSIWK

SEQ ID NO: 24415 - protein, 76 aa, Candida albicans
QQKLYISTTAAILELWTPLYSGISALYSIRFIYFHARFVQLGLWYSFFFTLYIAHLQVRSSRINTIDNYLELFRVF

SEQ ID NO: 24416 - protein, 62 aa, Candida albicans
QILIPHSMVTKLLICIKLIMLSLISNVFHMKLSLSILAPFRLRKIVVKFIKENYAYERYPRS

SEQ ID NO: 24417 - protein, 470 aa, Candida albicans
NIYPDGELWISKLFINWQNKLNQPTTTIKIMEYLKLTDSTLISYYFQKHLPDSNDLQELNLDSSLKFILQILDHYQMTDNNFVILWLFNYKFINKLQSCIGIIQNSTKFDIITKFNLLNCKVSFIMSLNYLNFIITQQILQNKFNDKLPDCVVQHFKLFQLPPLSKSNDFVIKNENNDINKPPQLASLDKIFTMIEQNDCYQSLIMIQFQILVLINKLMLDECKSIEYINNQQLVSIADKTGDIDQKSLSYLLQEKIVLSYLELFMVSLISPLLMINRFNQKASTSSSTNNETQLVKHFHSNLIFQIFNKILNLNYKSLPRNKIWICLINIINDICYTDLRYIELFIELFEYQLSHQINTHNNKQSNTDKEKTDYLKDDLINSGLKFFIETFKPNHTWNVAYSDKPSDQDSRSNQHQQQGHAEGGNTQLYQINLDDYKFIYTGDNYNRFSTFNVYPIHNNFTNTNSMRSK

SEQ ID NO: 24418 - protein, 65 aa, Candida albicans
PVKTAHIPPKPPAAKDLTLSAKAESTSSMFSVLSKFYVYIYIYEKSKGKIGLFEKKNENELNIFL

SEQ ID NO: 24419 - protein, 67 aa, Candida albicans
HIQPVKSSYFSVHFKLHVNYLFTRHVLTKEDEGNKKKISDTKIVGSTMEFPTKISKRIMLGVNITKP

SEQ ID NO: 24420 - protein, 268 aa, Candida albicans
ILKSRSVFFFLVEGGQHFYSQRFVAIIYELINTMSLSIRLLENYYQIQYSYLCTNPQLLNTATPSANFVIHVDILINNNTLTTKTFDSQLITGLASRFVKFWELLEYDVNLNISDDSSHSFNMGLKCKIFELYAPTNCLLSLNLKLSILTQENTIHLEDMCTNFNYLLSSWNLFMETQAPFVFSVIGRQYAKTNIFWYRRVRRDVLKYDSMDLDKVLILLEDKISHNFTVQQLLLQNVKLQSVLESTSPVSRKRGSGAIKSYPVVLIE

SEQ ID NO: 24421 - protein, 66 aa, Candida albicans
KKNSRISKMQVFTTGLEGSPLHAQSPDHGTPPITKDPPHQMRRQPGGPPAHTDTAQQGPARHRERG

SEQ ID NO: 24422 - protein, 116 aa, Candida albicans
RKFFYLFSSCFYCPIKENFSFFFLFNKYPFLFYLSLFFYLIYKEVVFLFYFIINSIRYIINSKDLCFIIIIYSPTHPPTYEKQSLSLYLPTTSSPSLILYPLSTYFFLEFTIDRYQ

SEQ ID NO: 24423 - protein, 60 aa, Candida albicans
KEKNFWNCHDGIVFFRIFHLVHFLFSRSEPKNQFGDTHTIGESINISFNKTFRRLPLVNI

SEQ ID NO: 24424 - protein, 66 aa, Candida albicans
IMNNELTNWTRRQHSFCWSNAVPYLTMQVSYYQNAKAHPKVLKRISKHADQCRLKMPKKKGIEKEK

SEQ ID NO: 24425 - protein, 61 aa, Candida albicans
LWFSNLTLTSSKFCAILSDVALVSGLLANDMSLDEEVKSSLEKMLTPSKIELKLIGFGGWL

SEQ ID NO: 24426 - protein, 63 aa, Candida albicans
VFLRFGIYIVFIKKKKCISKISWEMLFYREKTTPKKIALLILSCCTSRHNFPFLTPQNTINVV

SEQ ID NO: 24427 - protein, 95 aa, Candida albicans
MENIGPNRLSARQYLLITFLITFVVSISTYLYCADYVSYNIWNSVTSKSNKPYISIKTLDLNDTQIDDLKRLGLTPKKSVEIVKPDNSKQTIHGR

SEQ ID NO: 24428 - protein, 89 aa, Candida albicans
ALDTTSQKSDTGSNTKSSGGSSDTKSVWIATTGSDFASQSNSDSSSTASRNSSSSASRQAVIIGSKDLTWKKTLLCGGVIGVSLLLNLL

SEQ ID NO: 24429 - protein, 71 aa, Candida albicans
NRNKSQIPNEPQHHPKKKTKGLIKKGAKVFRRKKERNNNNKTPPPLPKMEIKIDNNSVPQVYYCPLLKSSW

SEQ ID NO: 24430 - protein, 60 aa, Candida albicans
NHHGSYSYTGNLNFVINQQTQPPTTVAISYCKKRTSMKSLFFRAFHSRCFFFFQAKPHGQ

SEQ ID NO: 24431 - protein, 64 aa, Candida albicans
SELITSWAYLVPVLFRHLIVFPFEGTAQKKYIKLHKLAEIYFIVPIVFRSNSETKIQVRVIRNE

SEQ ID NO: 24432 - protein, 85 aa, Candida albicans
KENAETILTSMKSKGKKSYKTPEGRRLISVSGNQNQQETSARKTRTGKKNHRIELFVTDNTNLYFSFGITPKNNWYNKINFSKFV

SEQ ID NO: 24433 - protein, 66 aa, Candida albicans
INGGRVSSTVIRFIFLRQNSVNNDALLYHFLKKEVFNMRHSEWQVEFEYYEVMKCIQFSILILYLY

SEQ ID NO: 24434 - protein, 198 aa, Candida albicans
SSSMKFYKIASFAFLALLSQAAVAQYDLETKKDVVAANADGTVGFNLVGKREVSEGEISKRFAELLLIPVILVAIKHALPEIIKIASALLEHLPDSGSVSVNATLLAEISAGHEPDLINQIVNQISSNLPQAITTVQQQQGQQQSQKVKRDTIGDIVNEIIAEGEVLVPEVVAFLERVLPEVVDALLRLAPALLGGLA

SEQ ID NO: 24435 - protein, 71 aa, Candida albicans
QQQFCSSVVLLFINTAIFLLQFLDYYFRFFFGLARSELFLFLYLHTCFGESFFYINIYLLFKIHLKKVLHF

SEQ ID NO: 24436 - protein, 81 aa, Candida albicans
HISTLKTKMLLHNNDATEYGVCCNHNEQNREIVLHYLLHAIHICGFNWFSLEHDFKRLWLNFIVLCYLAVIEEFGVQLTKH

SEQ ID NO: 24437 - protein, 139 aa, Candida albicans
LLPTIMITTSLKRSRSLLNKVLPIDIEGDKHSSPSVVTRSSPILNHDSESLHLNKSLVSKNSNKKTSKSPSRQGSNNKNTKKTNGHKKRRNSSYQKERTEKSELSQSKRGSDILDQRSKLDWILIVAIGSLILLIYILN

SEQ ID NO: 24438 - protein, 124 aa, Candida albicans
  UNSURE (55),(81),(103): Identity of amino acid sequences at the above locations are unknown.
HIHPPRLHNYNLSDTSSKMRQFQIILISLVVSIIRCVVADVDITSPKSGETYSGXSGSASIKITCDDSDDPDSPKSLDNAXWYTIPLCTGPTSYGDSTVWIHXSKTKLFRLIQNGFHCPKLSTQ

SEQ ID NO: 24439 - protein, 68 aa, Candida albicans
RCRTTGKENTIYTFKLSKQLILLLKQNKQQLKATYILSLLYCNKAVFNISSPLPFYSNNEDENNKLSK

SEQ ID NO: 24440 - protein, 277 aa, Candida albicans
  UNSURE (16): Identity of amino acid sequences at the above locations are unknown.
DHLVQVITGRQVHQQXQQQKKAHSPTLSRITQKLLMVQEEETPSLAQKSASAATKLSASQRFQQRVREAAKNGDLVTQKKETFTSVTFDPNDTSKLSIRKYSEIPTSPETEVQAKEEEPVPVKVAVAPQRRTRDQVTRHNTQRNSHIPMPKNTDTKSSNSSIDQKSSSSNNSTGSVSNSTSTTTTTTTISKKVRFTGVPEWTEAEDAPTKYSHAILRNFAVFRHPIKTVKAHNSKSDQLLHEESMSFKTSTVVVDDNEVMIAPKPKSGFSRIKSRLI

SEQ ID NO: 24441 - protein, 61 aa, Candida albicans
YYRLRDDCFKNGGQSVIIAIVNNGIMNFISLSSGQFDSLQNVKTRLNEIYPKKIHSIIYNE

SEQ ID NO: 24442 - protein, 504 aa, Candida albicans
YHQRKTDENFNFPINEGFNDLIRRFLQLPTITRELISVHPYFIALLRFPAIDASFYHRILDPNYLKINWDATEFVLKRSFIIPEGGEYRNQVKGTPLPTGGRIRPPASIQAQNDMFVQIMNSSNNGNGNMNGQNWPNGPVPPPVAPAVLVPTVNGVQNIQNVANLQNDPNNGSLVKLPLSTQLFSEGIPAHSRLTKFFFPDALPDDLTVDSVEQEMSVEEFKLCFASSCKYYRWGVYRTPNFVYLDCTIGKLHFTPEFPNENLNPGCPAQIKLKVENNRIKMTYLFHHNHSFLKCEKDNVPTLKKDPVRAWLIEQALQGKDWAWVKANKEGINIAGDVEDIDLSKRINRKLYFQICRLLGAETPPDEPDESEESAPESVSPSTTANDQRESGYMFDDETHGLVQNNSYDFPTNDFHHGLSESSPANFDIPNFGQSDDDDEVQAETEANNRRALKAECEGILKYVESTMESAFEMLPVQRLHDLKEFMKNTAKQMEQEFLSNHST

SEQ ID NO: 24443 - protein, 537 aa, Candida albicans
IIHKERARLGSHHDTLFKKFALYCTMSEVPNQESPSSSIFKQSNASTSTKVYGAPSSSQIANVDFYTLRKLNTNTSFSSNLTNSTTKTSNALSRLFTRNKSSSNISIHPSSSDDDSSPKTLRESTSPSESSKSVSGNKLRIAKKLKFPKNQSSRKPDLFLDTSSTISEDSSSFRKVIIGNLLNEMTKPRKSSMSSPMSTTFHSLFHRSHHNSSNLPQDTNYVATGTTPLSGKFDDLSKSSKTTLCLSSNSSNSIISNPELAQIYNFTNPNISIEDGETNMDNTNSSFLDIHKKMLVPADLFIQNKLNKYHQTEVGLGIYESELDHDNDNKIYSNLYHYLKPLFTPSFTISDSGQKGKMRPILGASVEEIANFVKESFCLHQPNHERSFRLKTRSSVSSLDREKVEDFDYRQLSNLFEKLMALLSHNLQTADSSEVSLQALILNAWKYYNTYVRFYLLSIFQPLQLHLNELSMRNHNGSKIIRIDDLLLVSFRKVFITEQGIGSGDRETSQFLGNAESEDLTGNGLLTSTLAVLSSIS

SEQ ID NO: 24444 - protein, 87 aa, Candida albicans
QDNNYSFLKYSFLIREEECYYYKKTSLNYWIKIMASSSSTTLKQKPKNNQNSNSKTYNVQILPIYFLLFFKQKQVQMISKIIIQYLS

SEQ ID NO: 24445 - protein, 131 aa, Candida albicans
VKEGEGGGAKNNETNFIFSPFSVPLRLVVGGGGGGGGVKTGFKILSQTINISIVNELLVRFQIVNILLTKRGPYYKLYCILLHENNYIIYFLQSNQNTITRNNFISYSTYKNFFSIYAIHFGKYLLYRREL

SEQ ID NO: 24446 - protein, 62 aa, Candida albicans
TLKKMERPGRSRYRYISLMIIFYQSALTAWQEEQNKLCYCPTTKLIIIINKQESNESNNSLS

SEQ ID NO: 24447 - protein, 91 aa, Candida albicans
IFIYFLLGINYLASPSFTPLFFTHSHTHSPFFWLSLLVGLTIYINRKHFPIEQTTRIYLIIEEIYLFQPYIKRILIYNNQKRDRELVDITT

SEQ ID NO: 24448 - protein, 60 aa, Candida albicans
NYKRVLKIRNFKQIVDAHKNKTIQQQHFTMKFHLNKPVTNMFLDDICKSIDVFILLYTLI

SEQ ID NO: 24449 - protein, 65 aa, Candida albicans
YFFFRSFKQLDNVVSKFVKFLLVFSSKGGAGILFDYSLIYKSQETTTMMMTTIATPIWSPPVVVD

SEQ ID NO: 24450 - protein, 82 aa, Candida albicans
YIRIELERQQPKSKKKFNYQNIKPTTSSTKKKKSQAAKISIKQKKTQNTSSKNTILFIIHTFIPGHIHFLFFLTPKLYLYHH

SEQ ID NO: 24451 - protein, 86 aa, Candida albicans
PLNYTYTITSHYERKENQKKSYKFKRWYVVPISFKFFFCRNQETWQALRLKKKKKTANNNNLSTLCTIPTANDQSRKSIMLLLRMI

SEQ ID NO: 24452 - protein, 120 aa, Candida albicans
QRLKSGWTHFKMVLFPTINRLANPNNAGGLTGSRRRRLFVPPSTQYPLFIYGDGDDQRSFLSNIEVGSQIYSPEDDHSDVASVSTSRSLPSTLSSVQTADDQESFHDWLHEEHRPSISGF

SEQ ID NO: 24453 - protein, 114 aa, Candida albicans
VTTRGVSFRIRVMRTWLVHSVYNHIVLTTETDSSIHEMMLLIVALNISVINTYTTHATNNQKIMFLFYITSSSSLARKKTKQRESYCLQYRHTTRFNKDLKAGGLISKWFYFQQ

SEQ ID NO: 24454 - protein, 82 aa, Candida albicans
LLFINIMKVWREREGEGWCEGEKENCAKSTKKKLVGGGRLVLKKNYVIGANYVILYANLYFKRLKFDPRKQAIKYYTKVKLQ

SEQ ID NO: 24455 - protein, 63 aa, Candida albicans
  UNSURE (56): Identity of amino acid sequences at the above locations are unknown.
PLATDTIHNLKVRPHIKYIAFSNLLIDTVDFHFDMMSLYIIRVSFDIHTFKSVPFXFFCVRPE

SEQ ID NO: 24456 - protein, 83 aa, Candida albicans
IDCKYYGSREELQLKKKKRKREKKNTHNQLNFVPHLIFFIFFIFQDSFLLLLLSYKSVSFSSLFFWNSYLLSHYDIRSKKNIS

SEQ ID NO: 24457 - protein, 91 aa, Candida albicans
RGCLSPRGEDLYDNSGLLTLNDLDIDTKNKLDLKKLKQYKLLQRRLKKEKELKEVESIMSKNLEKMKKGNKKKVVDSNGKVHFKWKNERKR

SEQ ID NO: 24458 - protein, 81 aa, Candida albicans
GGSQDDSLVDWFKKYSLLWDLDTLIVQLGGKPVDVDAMMIYYCKKNQAKLMTNNTTKGNNENLVLMKNIEKERSFGKCTLP

SEQ ID NO: 24459 - protein, 130 aa, Candida albicans
LLGLHYSEIFCIMFSTARKGVISSTGKYRPKLYHGITILNINKSFFSKIALTHDMVGKTPNSVNKNTNRHIFPFHKISNSGFSSGGQKLSYSKMCHHSRSSDNSASVVNQEREVLPTNVKPLHYDLTIEP

SEQ ID NO: 24460 - protein, 77 aa, Candida albicans
LHLQLQLHQQITLTSEKYMRDLYIYKKKSPNLKLKSNSKTQKPNLESNQGVKQINMSKKNPQSNIHFITETIKTSKL

SEQ ID NO: 24461 - protein, 109 aa, Candida albicans
RLEVLTISNFNTILLIILYCLLWWLFLDTHSHTLLPLVGSVHICDISQQQQQSRLFLLSFNYMSNRDHQSHILRVHPSILLVSLVSTVLLHSLHCFNALVLLFIYNYNK

SEQ ID NO: 24462 - protein, 65 aa, Candida albicans
VAVFIYQKELIKNRNQNCSNLIYNYKTFFRSFLYDVLFVISYKWVTEAEKINLHTQIIEDCLCTS

SEQ ID NO: 24463 - protein, 63 aa, Candida albicans
SDTKPPHLVIELFHKQTNNTNSSTSRRNQINQSTKLNNRNFNFLTQNIKKNQNFNNHMKKIKD

SEQ ID NO: 24464 - protein, 85 aa, Candida albicans
CVKKNLYFERDSNCIKKHNIYSLLLIELSLLFHCFMIGFNSSFSVFFVNIAFYISLKVFIFVLTRAKSLGTYRKIIYVRRVILKR

SEQ ID NO: 24465 - protein, 88 aa, Candida albicans
ILACGSSHPVVKRTKDKKSINYIDTSKINEKLNQFRLDGGKNSANTNNSSGGKNFRPGFTRNESNGQQGILFEAFNFPSVAPPPPPYC

SEQ ID NO: 24466 - protein, 61 aa, Candida albicans
PPSTLTHSYQDRLQTTNKFSCYYRYKLVNILIIKYYLYKEKKKRKITDSNPIIFFYSFLYY

SEQ ID NO: 24467 - protein, 79 aa, Candida albicans
ALQLIKKKKSLSLKLKHITTRIRNIRIIFFFFFCILLRYKLYMFSSWNMELGIHNNADMFTYVSTFYITKPQLKSLNNN

SEQ ID NO: 24468 - protein, 164 aa, Candida albicans
TLTNHKNTLNKLIDIAIPLSHPSTMSTSIFRTLKNIYSSGLKRAAWQIHHHNDTKRGWLVGIDDFGNKYYETDAPEEIHLRTRWVEYSQWNQDMSQVEPGWHYWLGYGTNTPPNALIGDAKTTRAYPLPAHHKPNLTNTPGAYVCYNTAKPKFKSWTPEVKERA

SEQ ID NO: 24469 - protein, 74 aa, Candida albicans
TNQELIQAPLSPDHHTMLTKHTQELENLRKLRATLEAIKESTDKMLQDITTIYKDNNPQLLQNSKDFQRALNDL

SEQ ID NO: 24470 - protein, 93 aa, Candida albicans
YFCVLVFSLFFVISSFSRFPLSHLEVSPIELELMKLLSLEREGRWEGGLNEILTTFHVLSEFLFLSIHVSFLTIGIIITIISTKTHLVYCSMF

SEQ ID NO: 24471 - protein, 73 aa, Candida albicans
NSNSNSNSMNNRVIGKNNNIPNYNEISFLFYNISNVLYSLLILIATIPKKKKNDNCYTTNVPIHYPNNNKTKN

SEQ ID NO: 24472 - protein, 405 aa, Candida albicans
SSRITLSSGPGRPVVKTSRKLELIKRLILYNFGNVINGIGEFIKQNKIFNDNELLITLFQTCLKLKDKVSQEIFATDDSLFLTIYESNRNTEWIVAYLNYLISVEQYEKVITIIDSRIGHFNLPESLGHLLLEADLHIEDLNKFQTDFKNLNLTPTNKLYELCLKYDLKSGELSAKQIIDKYSKFAAATAAANNNGLIELQELISFCHVLCSLQSSESITNPYRTTKFESVNILATSLLTTRNFDEMKTIIDFNDIKIEPSKLFDEMISILIELSSYNQSSESQLLMMNKFIDTIKLCKYLRLKSVSMENFLKIIRFLTEIKSDLLTVILNRFINNNNNGHDDADDNVGSFADIVMFYFIEVDLFNYKSKLIVLKELLNSMKKLGDNFNVLKINEFCQSNGIRFS

SEQ ID NO: 24473 - protein, 306 aa, Candida albicans
SSIFNLKMEQSQGNIANSPPTSEIPQRPIILSPPPLDQNSLNQSFNNLPTSVPQGHANRQQSVGYNLQHEFETLTANLDLDLNSSTRNITQSAPPNQQQQQQSQLQATDSQLLTTTADLNTKPAHSVKPTLAAPAASRYGSHLGSDLLGKSTSSLLGDNNPVSPIQKFSSINTQLDSLLNNNISGAKSKTGTNSPFLSNAGLSNRPQSVNDFSNIFNRQDQQQQQQSQTFLSFTTQQQSQNQNQNQNQSNFYLDLIVFSNWIENLNPQDNLTMIDYLCSNLPLDILLNFKFQIKIWHLQGRFTSKI

SEQ ID NO: 24474 - protein, 91 aa, Candida albicans
KKKDQKKNALKKWLRTDYSKSIKNFRAREILKGMALSRRDIRSPCKLLSFYKKKKYTVYTSVLRIQLYHNLKHQQKLNYFFKIVITSSSSN

SEQ ID NO: 24475 - protein, 255 aa, Candida albicans
  UNSURE (212): Identity of amino acid sequences at the above locations are unknown.
PRLIREARILPAPWVKIECNEVFTTNMSKFDAYTKDRTTLYQSIRLSEKQFRSHLLSNIRAMYIDPIIACLGLLYKQEYTNINEFKSTTSIKCGFSYIAKSAEQDEIKNLKESSIILVYNKKYHLLVIKLNHTSYRPSEIIYPNEFKQKVASVFGLLQMEEYSPESTAIFQNINLDYNAITGGLVYDKLVSVSHTYSEELQKFLKGLDKDVXIADFVNYEKVFKLDEENGVNDDDDDMDVDEDKPENTEEDSHNN

SEQ ID NO: 24476 - protein, 79 aa, Candida albicans
HYCAELLPSSGYAKHYQNLKDTDYSSVQNSIRRDRAGHFALKFSTNSRYANSTLPLKAITANNWQNNFFLYNKTCTYLH

SEQ ID NO: 24477 - protein, 68 aa, Candida albicans
KTVLIGITRFYHGKSVQHAEIVQTEVVFEMQKIQTQGKAKLSEKKKKRTISHHNSLHVVTIFPSLKKY

SEQ ID NO: 24478 - protein, 96 aa, Candida albicans
RKYIFKSRPNTRMVEQESDPELLEPSYFLMKARTKYLQNPDNMIVGCQKTFSNEFFNHRKQAANLAYKIFEDGVEDDESDLDIVSKYVTPSDVMTA

SEQ ID NO: 24479 - protein, 64 aa, Candida albicans
  UNSURE (46): Identity of amino acid sequences at the above locations are unknown.
NSNGNKLILFKNKKNVFKKKIRRIKIKSVSIVSLLLSLSFLLLGPXEQNNPPQWIKINKGEIFF

SEQ ID NO: 24480 - protein, 184 aa, Candida albicans
TSNMSGLKNRKSTINKDQNAKKTSSSKVADKNELKDPVETTSFDTEDKITKPILQDEPQKHHHHHHPHHEHDHDNDNDHDHDDKESTSMSRTDSLQKKTHSKKLKHHQKKKLSESRRVMFIFGALIGLILAALFTTNSESFTKDLDKLVNLDQFSDIFDDWKDLKNLKGLLVLTRQRRQGNAGR

SEQ ID NO: 24481 - protein, 96 aa, Candida albicans
LGLERASGSHLLEFIIRTMEDEQRYLIRDVCDYVPNLTIKKYQKKHLSYFHGFRSFFKGRDLNEVAKFIRLPQDPNESPQESWPERINTLVFDVLS

SEQ ID NO: 24482 - protein, 117 aa, Candida albicans
SGPLNLYNLMITTGYVVPEYLARNELNKLTYSPRMNFSRFQRKVTEVTSLARRSNYPVKDRDVVMTIIGNMHKSPSTVEIALTAYRLKKYESLLVFFVFLKKTREYGTSATVLSVIQ

SEQ ID NO: 24483 - protein, 62 aa, Candida albicans
IGIEPREARVRNLTLLRLFLFSPFPTGLSFISNTDKQNIKNYTYIYTYPQQQTLIDLAIISI

SEQ ID NO: 24484 - protein, 545 aa, Candida albicans
TSSSSSSLLQPQRATVTRSMFTSNIPSISSPINEEPYSDDPDYNAHEDNFQNDDEVSSGGNSSVTSPYTPQQPPYKPPTPTQLPDDLDSIRSHTIQSSKLSDNHGLVCINECCRTTSSINWRYFETEYRPEYSKLLTAHKFDKRNYEGMLGPLCNACFLFYKNKGFMRPEHVVRKYIHQQRYTAKLRKKQKEDELNRTTLDAIAMKKFVSGTSVSLNAGSSPAASFPAPSHTPSAINQVIQNKALTSHGNNNNNFSYDPTPPGFTPDYSDLLHQINVYGGPSTDIDPLPGATPPMVATKSNTRVINVDVGDSEVEEYKKATKLNTRIIGVPVESNIDNVNDNDDDNNKENLPPKINKTTRNDYDAMINSFQENNNDWMCFFSSPKNHVISPNSKTPVDNPNEIQNQGQNRKSPLKNVTQKTIVNMPSSPYQSTLDAPSEDDHDHEHEHEHENDQQQQNVLNDEISKMINMSPFKSSPNRANRLDTGNLIMSNQNKDDDKKNQASTPNTEFYSNDDDEGQHNEGHKNITKSGPSILEKENQSVSQH

SEQ ID NO: 24485 - protein, 298 aa, Candida albicans
NRGFQIKLSRMLCNQALIRNTPRFVRCLSRGATGAPIITSKKEILDKQKTKPSPSEVKPVSRRLKSASKKKQEKTKITSKYLPLSALPHFPNPEEARMGRPRGIDFQIPKESLKLSEVKISKEFDKEARDLAGKIESFSQKEADDQALIAISKEIGKYLEPELNRMYPSKEHPMRKSLSGMSKINPTLDKIEDSYLWEILPPKKLFGIPPYQRGDPLGFKEWENKLIEKEEKKQLEDEAYKKKYGKMMAEVSDADSFITSKRGARKRINRKLLKNYKKLEKDAKLPAKDKLVIEVIKL

SEQ ID NO: 24486 - protein, 67 aa, Candida albicans
LKFFFISILFIFCLYMSVLLKCVIKESVQHTNSYPKSCSIFLLYRLEELNKIEDFKSNYQGCFVTKL

SEQ ID NO: 24487 - protein, 69 aa, Candida albicans
WHRSFLIREYKEDFIFFLVFHLLSFNFFLRPYGSILDHFIFFFAGLFNYCTIIILIKDQKLQTLYSKLV

SEQ ID NO: 24488 - protein, 223 aa, Candida albicans
RRRRRRRRKKNYFVMLTLVNKSWKSLYSYKTGKIYLHLKNNELVSLNFSITNKNITNYSNNQRINTLTAPPPNSTLFLMEDELYALTPVSSSNKDLCGNGQISLAKYKDDNTWTSDSDIKLNFDDIIDASFYQYQTVLTSSNSNHTIYIYGGICSESKYVTNRLLSLNLNTGKVSNISTSTKPQPFYGACNILAPNPQEQLIIGGKLNLGWLNMYQLAIFTTG

SEQ ID NO: 24489 - protein, 60 aa, Candida albicans
RVESTRVLKCLRVWVLTRIITTMRNHSLLLHNNYRRSIHIFISEVCIFLSYMEIQLFMLT

SEQ ID NO: 24490 - protein, 60 aa, Candida albicans
RWETVSNYFGCLIKGVLLTNIQFRCRTCNSLLDFQFASGKIKKSPVTPASIFTTDGRNAL

SEQ ID NO: 24491 - protein, 60 aa, Candida albicans
GDMLEYGEKKNVGIRNIRKNSEFKVRDYKKPFGLQIHDAKVFTKVYLILRQHKQLNFHIA

SEQ ID NO: 24492 - protein, 785 aa, Candida albicans
  UNSURE (12),(240): Identity of amino acid sequences at the above locations are unknown.
NNNNNNTPPPTXPRHKRLNSNTNGHSNSHNNTTTTTTRRLQSSSPYINNSKPNTPNLNSTTTKTLESPALTTSHQQQQQLHAHSKRHNPKQTSNNGNTTTWNLDNIISQYNSIGKLPPLLSPTLPDSFGDISVELDNDDIPIIGTNEIIPDDNDNDNTKKLSAPKPTYPMQSKRMINDVNSDMNSSDDDDDDDVPIRRLKHRRFSNDDKSLTKPKQKEDRKVDEMPLSMLSPTLPLMFRXLDHDYSTMKKVNALPSLSTTSTNNGHSAPINNSSKSTSTSTNGSAPSFFNIQTKVGTFKWIDKSNDPNKPKFILRMTVNNKMKYKKYFNKITSPLQLTGFKISSSKDYINDEGSNDGDEEEGNEGEEEEEEEDDDDEGVLDDEDDDDGDDEIKKLISKPNKSQIDFQKKRDKTKQMIRQLKEESESLSKNNQLQEQQILEKEKMLKELKAILAQKNETLKHLEQKLNLKNQEQPSSNPKSDTKSDSRSNNNESPRRSTISDEMRRRELHKLTEDIMRKQSTQSSKKEPQSHPQSQSYSFKRIDINKFIITPTNFEKSFTNLTNSQREDIKFDLQNKKSHWFQLSKITQQKSDEYFNNLNITPHITINTTRNPHIIDDLILSMIIQIDSFLLRMVSNDFDERSKIISGVLPSERSWKLLDQDIENFITKIDNHLKLQHKQSLLPPNRMFGDFCTIINCIMFQTRALIMKRINSILTSVIQLYIDKRNHELNLKIIELQQLSINNNLKIIEFFMNSNPSYLNDIIPIKFPKSWGKKCVNFTICSTTI

SEQ ID NO: 24493 - protein, 263 aa, Candida albicans
VSRDISQTSERHPLLLITMLKRGIKADTPIEVSAASLRARINNQNSHLKDNATRVTKPTQQKQMVTRSQTKALQAQLNNQLHANTTVTEPDAQLEEIPVVDTTILEEQSVEHVSDSEVQEVADEFIQQNLLQVAEPLLLPVEGQTPPPQQSQSNQSSPTIDTNITQSSVEVPLQYKVEKRPRSIRLSKFSVTHDQIDDILQTILNQDLSCHISFATLLRIVPRFRKLVQSSLQAHLIPRFGPPNAKLIKPITVSDLEPYIPSV

SEQ ID NO: 24494 - protein, 64 aa, Candida albicans
LPNDNDSLLYLSFILLIGLDKSDIPPKQKLETASRYHKILKLMAFMGLLIHFQKDLNSNKQLLD

SEQ ID NO: 24495 - protein, 60 aa, Candida albicans
SNTSPNTSSSLALSLMEVMFLKFHEWSIFKCCKNLLASLKFLRRLFPYYTVTGLTVSNTI

SEQ ID NO: 24496 - protein, 74 aa, Candida albicans
IFSFDIQSKVTAIWSKPEQHLPKLAPVTKPKTSINAAPKLDRIKPYGHNNGLSWIENSWYKSMIHSTKVVLTNP

SEQ ID NO: 24497 - protein, 82 aa, Candida albicans
WSFFFNLPPNLKRAINYYPNFEVRGGWRLVDKQTGEEKFILKISSRGKNSQETTKLRRKTKKCWTIFFGSYTVVNKESGRFF

SEQ ID NO: 24498 - protein, 65 aa, Candida albicans
TEKFRKWTSLILSKPPTGVKKESKKKKFTAQEREQSATSISCQYDDEPKANNTNSPYIKILQILT

SEQ ID NO: 24499 - protein, 76 aa, Candida albicans
ISFFLTLSLLQLGVLKGLKTSTCEISPSKFAVSPTKSKQQTQEQEKKKLHRCLKLQQSNNNNFFIYKYRFHFHFFS

SEQ ID NO: 24500 - protein, 201 aa, Candida albicans
KMLPTAEQPISPLDENPLDENVNNLKLKASSGNDKEDGSYNLKAVQQDGTIDDNDALRKLLDIDRIFRSVHSGPILPEHRSPSPNTRDDSSQVIGNPLSFYYSNDDKESRYDEDRSQGQLLGKSKYPEDEQQLPNRFKLVDDEDINKAPPRKESSRPTHSRSATLSGFMQSRILGRSTSTNQEMPNTEPEFANLQDALHPR

SEQ ID NO: 24501 - protein, 71 aa, Candida albicans
DSTKSGRFIKTLRRFNRRKTKDKRQSTMTAEFDELNDESENATIERAEKLLAGMSTGCSCNQFNGLVSIRR

SEQ ID NO: 24502 - protein, 63 aa, Candida albicans
IPQGNFNPNVINVKNTLTTNANKSDANSFNNCFSVCGHNDRSNSPPLHGVAKSNTNSAEACFV

SEQ ID NO: 24503 - protein, 61 aa, Candida albicans
KFKTCQRGVKNETTLKSLTQKSWKRKREINHHLGKQSKDNKIWTLQHEPPTSSFYSRVVSE

SEQ ID NO: 24504 - protein, 95 aa, Candida albicans
FGDIAWTYSQMYTKMYSHSTYLLLPIESIVKVIITNNQLKQTTLCIILLSSSRHVTSQLIVILLLAVTWNNPEQLFIVNEQEPPYRNTLLFITID

SEQ ID NO: 24505 - protein, 76 aa, Candida albicans
LCKSLTRFFFVQSAIRNCCWLRRRRRRRGHLILLFIRTSSLYFKQVNRLIKILSKENLSVLYSIVLFELLLYLSQL

SEQ ID NO: 24506 - protein, 62 aa, Candida albicans
KGGSKKFEAELLKVAVILLNEQGCIGMHTYILPNSILARLNTCQSIYCLTYKEVVEKCEKKK

SEQ ID NO: 24507 - protein, 69 aa, Candida albicans
YRGVFLFAQNLTILSICLKCNSLGSTFTISQVTSLSTYNLGYALCYANLLNNDRLCWSKTQMNTIHPKK

SEQ ID NO: 24508 - protein, 171 aa, Candida albicans
PSVLLVYTKFRLNFSMFPPIKLSLNWWLIFEYDLITTDLAKKTESCGVSYSFSLENPLISLLQLLILLYNSSYMTPLDIFIENMYPTINYYLFANFNFEVDISLSCMKISQFFFHPHISKIMSSSIVRHPRKKKRQNYRARYAETKFIIYHLFRKNNEMDYHTSTTIEAPQ

SEQ ID NO: 24509 - protein, 82 aa, Candida albicans
RSHQSIVLYFRDIYPRLHKATPNFVHLSPKLNKTIQNSDVRKIGLSPTTVDNTYTSLHFTTPHPQSIYSLFFYPTPPPPPQE

SEQ ID NO: 24510 - protein, 96 aa, Candida albicans
RIIFKELDKSSLYILFIPPKKGYLIKTNNNLIGKLIIANIALKEIIMNSNIDLVYINELLMIHYWRNSGSVYIQTEDKCQLIYNKITRHPFCFFYA

SEQ ID NO: 24511 - protein, 97 aa, Candida albicans
KRSKCIDKFVFRTYPFTDITRFPFMLLLLEKKGDKFSLLYGEKRHTVTLLVKELISGGWWSFIFFFFCNQKTLVTILNKMRRILGVCMEIHVKLGQT

SEQ ID NO: 24512 - protein, 209 aa, Candida albicans
QHKRKPSDVRKRIRSEYKFVNAFTPFLLNQQLYDQDEHRRLFSQLPKLPPQLGQSILEFIDNAPVSITTITTPTIEICQLRNDLGENIPVKPKSSARKKPSLKQAHFKILSRRCCRPHKNSNTTSATTTNNNNDDEEDNYQIRSSSSIPSDDTEEIQVQLVYNKSNTPKYLGQFINVYLDNRLKRQCKSCPAMYTDLKGFNRHYESKHL

SEQ ID NO: 24513 - protein, 61 aa, Candida albicans
CKKRLARIEKFGVELGTALAREIGLVDNSLSNNKFNHHKRNNKRGFKGNKGRKGGFRKNRN

SEQ ID NO: 24514 - protein, 106 aa, Candida albicans
DHRQLIFIANQFFFFAQHPRQQFKAASHFNNRFHNLMSTLYHAIMYTDLKHSLPFLNAITTSNYLSQDFVTERTITNRKKRDHKTKNCLVKKNFAYFFLLPFFSLC

SEQ ID NO: 24515 - protein, 134 aa, Candida albicans
LFIDRISLTKSTIGVIKKLEEAIKLIESNNNNNNTATGSGGGVRDSTNINGLLNEAKSLLYKPTRRALEQIKNGDNTNNTASNNSTTGDDVNDGGSKINSTTTGGSTTIDVELQDDSFKPLSLKTPQTFKIWAP

SEQ ID NO: 24516 - protein, 60 aa, Candida albicans
GGRGINFLSVDLNQLELRQYFLFNFPRMIIENMFSLGNNNNDIINSFIYLYIYIYKTSFC

SEQ ID NO: 24517 - protein, 76 aa, Candida albicans
GTMIESITTLNENNKIYLSIDYKFLSFVFILFNLFIYRYINNTNIYIITLYYSFSISTPPPLITLWCPNFKSLRSF

SEQ ID NO: 24518 - protein, 120 aa, Candida albicans
YKLVCIIFVFEAFVYKLFNRIWNCKKKTKEHFLLSQVFLQFHFFVLILLLQTYYGFKRGCSGPGTISITKNRRNQIGIKIKQNESKQINAQRPTSYNNKTLALQKFWTVLNFNCLLFHLI

SEQ ID NO: 24519 - protein, 71 aa, Candida albicans
LELIHWQWKQLDFHQWIIPLLSFQRTFVLVIEIYNKRLRVFGMKNYKGRKKFQDEKNMSVCVCSQLYYGVT

SEQ ID NO: 24520 - protein, 73 aa, Candida albicans
YQTITSFKKTNKTLTVIYSESVLLYWCLIAIFTAVIVSESLLSNKRNRKQKILLLQRRVAFGERGSFFCWLEY

SEQ ID NO: 24521 - protein, 65 aa, Candida albicans
QKWRTITLSTSTFYIKSFFFSISSYVMRRDDKLKVAPDPFCQNQSILGKHLHNFDYLLFQDLQKI

SEQ ID NO: 24522 - protein, 70 aa, Candida albicans
LRQTNTPLDPFVSPIGAVIPNQVYLYLGNLFIRSRVDLFRLLVSSIGSAVYFGTNRVTYSFGSDCKLRVH

SEQ ID NO: 24523 - protein, 81 aa, Candida albicans
  UNSURE (80): Identity of amino acid sequences at the above locations are unknown.
INEMQDKSGEVRIEKNKWAEQKTRGKESNRENINICESALINWSNDSLFLILILGLERRRRCTVNHHNVRYRCRDVDEIXC

SEQ ID NO: 24524 - protein, 70 aa, Candida albicans
  UNSURE (21): Identity of amino acid sequences at the above locations are unknown.
SSEICVDCVCIIDERELMLRXCTQTQKESLKRLSENKLTIGAEKKLKFKTNTVIAKKNRIGSLTQQQHVI

SEQ ID NO: 24525 - protein, 134 aa, Candida albicans
  UNSURE (101): Identity of amino acid sequences at the above locations are unknown.
IFQLPILFRQDKQNTKIRTKFNCTTKNILISRRSLYANLVLLRIRRGNCSQITCCCCVSEPILFFFAITVLVLNFSFFSAPIVSLFSDKRLSDSFCVCVHXRNINSLSSIMHTQSTHISEDYPPKRLINIWTGL

SEQ ID NO: 24526 - protein, 63 aa, Candida albicans
HDDRVRPNNVVFAYNLLKQTNNLVLGVYRVLVGIIVSDQLNNNEIKKEKKKRIEKKQRKRDCT

SEQ ID NO: 24527 - protein, 61 aa, Candida albicans
LCVCVFKFKFISKSKLSVINDYYEINPNSLPIPPFPIKYVEKKKLNSTLDLHHGPPGPPYG

SEQ ID NO: 24528 - protein, 104 aa, Candida albicans
SRTLGVRDVGLSVDVKSMGTSAISKQNFQGRHIKFDDNKDGDEKKDDGNKNDLKKSKNKKSNGTGSSKSNLKLKLKLKLKLNVKESKITKPKSNKKSSTKNKNK

SEQ ID NO: 24529 - protein, 71 aa, Candida albicans
ALYQATKAVIKPNTPPAFLIATLPVKSEIANNKNVILKKKNIKKNATVDLTVKSIKKNVKINQPIKNIPTA

SEQ ID NO: 24530 - protein, 72 aa, Candida albicans
VWSLPFECIFYTIEEHLFVIQIVLPLWLSFEVFDFLIYIIDKDSDIRLVKLCTSSILAEGLTVGLLHQTNLK

SEQ ID NO: 24531 - protein, 91 aa, Candida albicans
YKSKNQILQNLTIMARLSGLQRDVLQLYRKCIRMVKTKPTDTHEHWRNFIHEEFAKYQHLPKKQFNTIEYLIRNGHRKLEMYLNPQLKDIH

SEQ ID NO: 24532 - protein, 61 aa, Candida albicans
LNSYSNPNINTKKKREKKNRSKTNCTKDIRNSSLMYYFSKVIVIEILFFTKDYKLKIAIIG

SEQ ID NO: 24533 - protein, 65 aa, Candida albicans
MAPSSFDLEFNSDLQNKDNSPQPSSSNRLTALEFNSENENESKNDNNNSSLPSSLDTIEMQPLDK

SEQ ID NO: 24534 - protein, 78 aa, Candida albicans
RLQPCIVKFLFNFTQDLFYPNVLVGLRSNGDPFLNQTIVSCTLFCIKTLISDHLKKKAREYCKLTYYGNFKFVIFCEK

SEQ ID NO: 24535 - protein, 62 aa, Candida albicans
YQITSDNSPVSSYYLHRPNLEDLTRTSKVGVTICYVRVQRSINRLNRFTWSPITWGASTAKF

SEQ ID NO: 24536 - protein, 183 aa, Candida albicans
  UNSURE (20): Identity of amino acid sequences at the above locations are unknown.
REEREKLIAQKSHDSNSTNXTEQATQKTKTEIVGTVKKIIHLISNFRPSSLGDTSVTNGLSPVSSNGSQSNQDFELKNAIRDIIMSLPQSLQQQQQLGPPSNSQDDVIFKFAKESLVMISKLTQIFTEKLDQVEHWVNGDEEQEQKLQLQLQLPEGLEKQQEDEREEENLAAETKRMKLDGSV

SEQ ID NO: 24537 - protein, 413 aa, Candida albicans
YRPYLLLIMNSDNNPTREPGFKRRKIEPEIRNNNSPQQATSNPGSNDQVIEILSDEETAPPLQSTNTVVHLDTELEDSSLSDIDYRDDDNNGDANNDVQIVSVNTANPTPLSTPLSNLNHSGVPTNTSTTNNNNNNNRNGEDRDEDDDDLQILGVRNIYDPNNGRLLTPVGDIPFVREDNDYTIVEDAPRRNLNPAIARAIRRILDMERRYPLPSQEQIRQILMENRPWMQVSQSEFRDRRVTFDNSAGGGGEEGGGGGGESQPRPQNYHEALQESARRALAELAAMREAAERAERENSSRQGENSFGFGTPRRSYVELTENETSQPVAVPLPRQRSVHFTEEALRRGNGGPTFSESRDGNIIRRERRQPVRYTDSPQFLHNLPLSGLRLSIEFLLNLPFPGKYIPMMWGFAL

SEQ ID NO: 24538 - protein, 85 aa, Candida albicans
WPRMPLAQHNAILFLSTEQFPVFVMLGLQEVNSSTIVSILLISPFLKASSNFNLSKDALSWGESFMILAVYSKVVSVLSVIYYGF

SEQ ID NO: 24539 - protein, 94 aa, Candida albicans
NFFYFSLHFFFWQIFFPSTSTPLPPMLSTTIYRRSFSVLSRSRAKRSFTPSDSSVESDEIVSENNPWSPTLEDDPVYVQERNKFRKTKLPEQYM

SEQ ID NO: 24540 - protein, 74 aa, Candida albicans
VIYLISKNTHYVNDVFTRQKQVETYLEKKEKNIEHCCVFEIKERNTTTTRVTASTAYQPPNKNFLRSSGVILSF

SEQ ID NO: 24541 - protein, 100 aa, Candida albicans
STPYTHTTIYYKMPRLKRALLSPKLFVKSILLFTIVYTIYLSTSTSTSVYLSTTQSKLNIYTNQLYQKINLQFNQWYYNILVYDYNLFGLHTGRKEGPTS

SEQ ID NO: 24542 - protein, 72 aa, Candida albicans
YMFINIYISFCLSYINLYNIQIIKNPSNIIPTIRVRLAFLFITVLNSPEVCLTSTIKELKLSFNESSREFSC

SEQ ID NO: 24543 - protein, 71 aa, Candida albicans
PTIEVLILLPLLSKSTNQSLQSVLSNTTSTILVETQFVSSFFKGPRKGGERSQQYLEVQSYAKHKHNCGFI

SEQ ID NO: 24544 - protein, 66 aa, Candida albicans
LFISILYYKSCMLNPPLEPYHDQLTFFNNRPETRNLELALSSFRYSRLSYHLTLTFWYQKLSKVFI

SEQ ID NO: 24545 - protein, 68 aa, Candida albicans
SHNFPYWGLVPTLFDINNKKKHSYTNYVLLASVALFDSFYIYFLLFLQKFSLFSSFLTEYPQLFYFIK

SEQ ID NO: 24546 - protein, 64 aa, Candida albicans
LLGGVGRSCCDSSVVGKNSGAASRILGQESGSGVDQARQKESPTKKRLSGSRIHHTLLFRQAIR

SEQ ID NO: 24547 - protein, 60 aa, Candida albicans
AFVFFLVVYSVVLPSGQIKIYGANKSYSLCSCFDFVLGLPCMNGEMTGVFTLALIIYNSW

SEQ ID NO: 24548 - protein, 433 aa, Candida albicans
FHVNIMHEEIDHTLTSSSTTGSASFNKRSNFQFTYDSETHLLLLIHKYKEDIFTRGNIIKTWEKVLQEFNERCHSNIVQSRTINHRFQMLKKNLENRLKHDNQLLDQVVLNENEKLLVDILEYMYKNSHTEVSPYSLGGSSNNSNIAANTQIDSLYAQQNPTAPIDNPLAIADMSQISPNTYEHKLNRDRAQYLMSQGFDHSIHHQFQNSMDFSNTIRQHQLAPSSGNSLLGANKNIVSGYVPSLEQPELINTSNQIGHPEETMLQPHPNNPASSHIIYKQPEINMSTSESPNLQHNSQHQPRHSNSSTPMGSLASTLHHQQQQQLSHDTKQNFGNNISPSIQYNNNTNTRTIDFAYRQDQNQNQNQNPQQHQYQTQPQQDNTTASLLKQLIVSQTQVTHSINALREDLLDFKRETNQRIDRLTSDYSLQQNN

SEQ ID NO: 24549 - protein, 64 aa, Candida albicans
NRCLKEYRRYIYSSEKKKPYAYIYVCVFNVSGMWFCATKSSINDMRFEPHWIRHVGHSIYFYFC

SEQ ID NO: 24550 - protein, 286 aa, Candida albicans
SYKLKRSSRVKSTEIHTQRKKIERKKKNSNKNFSIYKAVVGLQFPYPTDFSTKVQTIMESPLATTLGTRMSAYLITSNDFKKQRQKINKQIKNLRHELNLINHDSKKYKVVKFTKDQYQSNKNYGLIYLLLAERDFLYGLEMKNILEIDDIKLKLKLKLNLNLKLHKNYKKLLITKFKRSLIHAKELLDLTNEESINDIKVELFVYTALIIGQLSIVKKNWEKTLHAFSIAKCGLDYLYNTHNNNNNNNNNNGEDENNDDDEEEADSFNKTLFNELIETLVDPSLN

SEQ ID NO: 24551 - protein, 87 aa, Candida albicans
KTVLNGKGTKMTGCVNFTLANSLTLANSLGLIEQTSNTVIALAAAQRRKRRKGKKKLKKIYGGENFFYTFSNGHHSKLSRDTCFNKK

SEQ ID NO: 24552 - protein, 65 aa, Candida albicans
ILQMCLVVKFSTVSAIRAVSALLILTHFPTTTGSGEKNTPNQNFIHLFFFLAIVGLHRADGRTHV

SEQ ID NO: 24553 - protein, 92 aa, Candida albicans
KVCLLVKVMSNEPSLLTNRGLESSSGDKSSLDSPRRTSKSILKGALAASAVATSDNNATELSLIYVEKKKKEKKSDGKNISIAIVCEEKNQH

SEQ ID NO: 24554 - protein, 90 aa, Candida albicans
NTFRKSIFSFNSKKLYFSFKFHNNIYVMTEKDEGKRLQLSLDKLGDWEKEMSQVEREAEIYRIKKTQPMYAKRRSILNDIPNLQPPPQSS

SEQ ID NO: 24555 - protein, 63 aa, Candida albicans
LIYYRKKHMFAVSSNQWFRWLIEVAKKRKQSVVLMMGSENCLEYKKKNLSHVQKLSMHTMQYL

SEQ ID NO: 24556 - protein, 69 aa, Candida albicans
NFLAKRNIMGLFGGTKKKEVSRSLSSSCSSKNSAAFSNFDEKQEYLKRCSSKSRDKKKAPQCVSFSIKK

SEQ ID NO: 24557 - protein, 612 aa, Candida albicans
  UNSURE (594): Identity of amino acid sequences at the above locations are unknown.
IIFCFPNVKPFTSNLMNIDNNTFDELVSSYFTIDQIIDRTADAKLYMGDNNKPIELMLIDLAGTGIYNSLAILSIDYNDDDDDDADVDVEISRSLMYPPFRINELSLLNTSNSIILKYIDFLSSPTTRTTTTTTTTTTTTTENVITIHCDDTELIQIWVLNLSKIFPIQRNNFTTTTTTPGDDKFLLDSHHSSPINMTGLGINVISDSELKQNMSSLEEEEEESISTPSTPERRTIPFRELIDSPTPTPLKKNNPSSNDEEEEEINEIVDNSGSTSNSSITSNDDDNQVNNNNNKVKLQSQYDRTVPLIKKTLSYNHQLDEDEDNDDEKYFQIINRKKISDEFSCHDDQIENRPKSSRGEVLTYNENDNEPSPIGSEQPSDSGEEDEDLISTKEIQLIEPNVPYHKPSLANSAPELNLKSKQTPVEQNTTTTTTTTTTKLYQLSTGSAVDINNFGKNYKPSFIQPIHNNDSMNSLISSNKSNKQKLKKRRSFFDLFKRSSKLNLIDDTPGFENIPTITTTTATTTTTNKPEKHETISRTVIEEEENADSKPISKPSSALPSPFALPSSTSTYFFKQYKENGSSSISLNKTRATXSLVSPPEQQQQLIIEEDE

SEQ ID NO: 24558 - protein, 62 aa, Candida albicans
NGMEWNGIRWMGGAGGGGILSKSIKKKKVIIKLLKNKNEDKNENRHNKRKYIILTRRLEVRH

SEQ ID NO: 24559 - protein, 78 aa, Candida albicans
ACCGCCCTVVAPPNNPPVEVELEVALAFVLAPNNPPVDAAPPPNKPPPTLEVCCWPPNNPPPSEAVVPGLAPNKPPPN

SEQ ID NO: 24560 - protein, 81 aa, Candida albicans
KEATSCREKKMELLTTTMKAAKKVDSLKYLTFRDTLFCSLIHFCLFTHCCNSETLRHCSSRKVYWHYAQHWSVDGGSQTID

SEQ ID NO: 24561 - protein, 299 aa, Candida albicans
PEKDTENFKETKIRPRSGHAQFLQSYSKIISIDNTTSGKLHHTIRITSGRAELHGLTHTCFMGTLIIGLSLLYLEDNGYTLKDGYSSCKQMSYLNSAKKIFEYYSQTNPISSRFYNIVEQMQLALMNKFNLDMDGNRINIKKQPQQKHENGASSTTTNETTIPTESFGVGTTDIPFNEDYDNFIDNFGNLLPTTTNQQHSTNNNMPFFMTAQPYQNTPSAYSNVSEELGNHQQQQAYPQQSSQLPDHVQQNQYLSQFLPTLDSNNLVSGHTSLGSKNQSESLDAFMYNVGLNDILYNTK

SEQ ID NO: 24562 - protein, 60 aa, Candida albicans
YLKHIFCFFFYSSSTSNLSFCSVAETRKKTTEVETENSHSSNKKIKLQNIARHFNCLYYQ

SEQ ID NO: 24563 - protein, 66 aa, Candida albicans
MLKLTFGCKYSKRNLFVVLKTITEKTNENIKKHNEELKYIIIKLIFLFFFTLKVARRCQQSMSVLK

SEQ ID NO: 24564 - protein, 68 aa, Candida albicans
QRLATFKVKKKRKINLMMMYFSSSLCFFIFSLVFSVIVFKTTNRFLLLYLHPKVSFNIYDEQRSALFV

SEQ ID NO: 24565 - protein, 69 aa, Candida albicans
SYYQQGPPPPQGGYYHQGPPPQQYYQQPQPMYVQQQPQKSSGGCCSAFCGTCCAILCCCCAEDCAEAIC

SEQ ID NO: 24566 - protein, 128 aa, Candida albicans
IRFSFLFLSIHLGNNITKYSVSSIMITTTTTTATSQIGDLNEIPNLKPPRETFVDQPKSPEDVNLEELIYDLQNGTKNVNNLHLYHSIFILSKTLQFIVKLLEHPNLYNEFRWQQLNRLGINEDDLME

SEQ ID NO: 24567 - protein, 184 aa, Candida albicans
EPGNINENNERNDNASSTLFQPQPLHMTKDTDFANEMSNIRSNTPSLSPPPLKMAKFHKNSIINDNKYYDELETSIEARIVDDVEVDRDSSIRSPDDISTLNIPSPTNEFESVIDENIDDIKYFSDNNNNDNNNNNDEPPPYIPIEQLVESTTITNQTYNDEQINEIYINKLKFFTTGLEGPRL

SEQ ID NO: 24568 - protein, 63 aa, Candida albicans
TRLLKKMTFLRRFEFTLPVNNLVTPKCVLGKWYVPQIIKFGRIFNVSFPPFSLDLFLFNFTHC

SEQ ID NO: 24569 - protein, 72 aa, Candida albicans
KNVLPFVFCFFNYANIIILFCTFKIRSYNVYAKSIAIKNFFVQMSTFIVSRKGKEKKLEQIKLYRCMHIPNE

SEQ ID NO: 24570 - protein, 71 aa, Candida albicans
DTLVSEFKGKSDKVRFAETCHNTNNTQHDGKNLSIATDNKRGKSVALLGLTSTGGSVAKHIVQKPTTLIVQ

SEQ ID NO: 24571 - protein, 72 aa, Candida albicans
IDPLGCKLGLNREETNDGRPRPRPPLFNLQMAPDFEFGFVTCSDDDDDDPTMRLPKLPALNFCKLLNTKSAR

SEQ ID NO: 24572 - protein, 134 aa, Candida albicans
  UNSURE (73): Identity of amino acid sequences at the above locations are unknown.
IHSVTFLGLLRDVIPNANIRVLKLHNLQEFIIGRYNLPRTEEMERYYQLELKEKGRGEKFHNYRYPRDVAYCXMLQTLIDEQGLHTPGLVAPIWDESLIKKRSETRAEKNARLKNVVEHVKRLRAEGKDFSLLE

SEQ ID NO: 24573 - protein, 65 aa, Candida albicans
IGYARGLVWTILLIELKPPPPHNGILLRRRSASLRRELTRNSCYSDCSDGSRQPIYLTYKLFLID

SEQ ID NO: 24574 - protein, 322 aa, Candida albicans
NKYIIMPASTFTITSTKPISPRPTSIKTATTTTTTTATTTITPDLYYNSLTPTPRFTPFSLEQFGFEEYDENESIVSDVDLLLLEQQDFIPSTQPPHQPHTSKYHTIVNTISPHKILSQYFATELFYANNLLQISNHFINREFDSFNNDLILNPNIPKTNHLELINQLTIMYNETMKLVETIEQFNQELDDIIVDNYTIHNLQNLKMSYNEKLDIHLNVPVHEIVDKIIDGLYQYNLTVEDLLEDEQEKEKEKEVVEVEEELSNEDKKSIDKIKTYHDKILSILNLQDEKFTIEKVEKFHNILQYEIIENKEWQSVVKLCPL

SEQ ID NO: 24575 - protein, 75 aa, Candida albicans
LRKVVVTPVFLILNYLLITHNHSFNICKYNNLYIHIYIYIYALSDLTTRIIPYNGHNLTTDCHSLFSIISYCNIL

SEQ ID NO: 24576 - protein, 74 aa, Candida albicans
QTFEPYITCFIFIFLDPWGQANPDEKDVQEKEDRRSGGGGGERKKKNDKGHEKKKGGGKGGEEEHNKIETKFVI

SEQ ID NO: 24577 - protein, 96 aa, Candida albicans
SLNTKFPRLYLPDEHARQVIIVTTNPISEIQRPDVTICGKYLPQILKTESAKFIASKVTNECHLLISNDGLLSTYRERIEFAREELTDAQVKTHPK

SEQ ID NO: 24578 - protein, 105 aa, Candida albicans
IIMIAPPEPILVPKEAETPTQEQVNEKLTAKSDHHPKFFSNDGSACDSLLSTLCSKLSALFSYLVSIFKLMREKKIEREVKKILLKEVYISFELMQNAWLSSANT

SEQ ID NO: 24579 - protein, 79 aa, Candida albicans
LIDKKSKQMRQRDKPIRKFKTFERKISAQKKTPSTNYNLLLLFLIVFFQLSFIKVLKSKSSFSHSFIHSFIHLYLYIIF

SEQ ID NO: 24580 - protein, 320 aa, Candida albicans
TMNGSSNNDNEVIVLTQDITYPPVTPSKQQPLSNNNSPTPSFKSPKRNNTLSPLRKKQQQQQQQSKSVALSSSSSSRENISRSNTSSTSALSQGHQVSEEEFKSLQRSFADSLLNLNNLENENQRLQHDLTIKNTQLENQLERIKFLEQSMKEAEMETLQNQDILNKQVEMYKEMIDKLQTKIVELNEELEKKLPLETIDALLFKKYEKLVRDYKILDSQFEVERNSKLVLIDQIEFLLRKNEELIKQIGVPIEDSDNESDANVDYLADLTDNVTHTMNELTDDEHEQEQEASVISPGLNIYHGIAYQSSSHTPLQGPSL

SEQ ID NO: 24581 - protein, 78 aa, Candida albicans
GDVCNASTQKYYSFFFLLRLPRLTNLVKGGYICMVLNFSRLEPKSLKNTAARTMNPALLMHTYFTSSKWTGMKFVDHD

SEQ ID NO: 24582 - protein, 76 aa, Candida albicans
FDYGSQNIRAQFYSLLKALKFSLNSKALFCESGLQRSVKALFLVLLLLVSRYKMYEKRVLASVAFFRFYIHWCLHL

SEQ ID NO: 24583 - protein, 98 aa, Candida albicans
KKNQATFFLFESFIVILMLFNHLCVNNPFPLLLLSLFLLQSNNNNVCSSSSNSRCRVCFCLVGISFPSQLECLCLSCLASTSYYSKNLIVPNNTNTEG

SEQ ID NO: 24584 - protein, 106 aa, Candida albicans
  UNSURE (100): Identity of amino acid sequences at the above locations are unknown.
TVSSITPSIIKLLSLLLFSFSSLLINWSEISSMITSWANSSPKLNQFFQNPKEVGNALIDTIIDKEVVKVKNFIFFLKKVQSFFFKLKENDKINKIDVGXRYKDLI

SEQ ID NO: 24585 - protein, 63 aa, Candida albicans
QKIRGKLATYLGAEGNRKINDQNRQRDNIYIDRLAWHLIKQMFYNVSQPPGSNTLSKLLTIQF

SEQ ID NO: 24586 - protein, 235 aa, Candida albicans
FSMNSDIDIHNNNSTNFFNLNIKKIIGTSAKNPHQFFIQDDLIAYTASGGVVVCTIDIETNEVIAQRFFCANISYTNHSNHNSNNNNNNNGLKKRRSIIGSGTSSANAYLNMIKSYDYSEKELKRDLYGYPINSEPMEIFGTSIENFDDNYTSNNNDVNGSTNNGTSGNISPSKLKDKVRSINCITISSDKKLLAIGEIGYQPRILIFSLAANSSDNPIWSIYEHSFGITFHTSL

SEQ ID NO: 24587 - protein, 88 aa, Candida albicans
RHLDLVSNDSETQLHNDKEYEIDLEALREKLKKTTVEPKIKDKEAKSKKKLKKLKKTSEEGKSTTTESNGVEPLKPKKVKKKKAIILE

SEQ ID NO: 24588 - protein, 84 aa, Candida albicans
IDLFKDITIESKAHAAYQRSINEQLNRQTGSISRHVNSMSTTFNSHTKTAFFVVASPIIRLPQSPSVRIINICLGFKTVLVWSL

SEQ ID NO: 24589 - protein, 63 aa, Candida albicans
RYKNQTSADLYLFLMSANHARTVRNEIQLLSVEQKRPFWPYLRITRIFILTTARPIEALQRPN

SEQ ID NO: 24590 - protein, 254 aa, Candida albicans
FFLFISCIIINHNYIYPYISQQMLTTKFNSISPIELLEIISSYDIQDEIKLSHIQNLKTHIKKDTIDLRNVPIYLQIITKGLEITRLNISSVSFNSLSYLIKRISVQDKSGNILKEECFLILPILINKLGNASSPAGTNLAKKSLEDYWLSSPIEVEDALTEIAFENPNTKITIETIDWMTQILKNISAKFNVPKFLPKILHSIEINPHNEEIIVSTKELLSIYLEKNPSAIEGFKKQIESHLLAQATKDKLLG

SEQ ID NO: 24591 - protein, 61 aa, Candida albicans
TCIFLRLIITRCPLMIVDNCKSICLIIGKLTNAKKKKKNKKKTREERSRKNSKITPAPNNW

SEQ ID NO: 24592 - protein, 64 aa, Candida albicans
RVSERATHKEKKKSGLLRKRSCITLQAEFIAKVNNVMMLYSKAYTSWNQIIKPSWALIYKQTLN

SEQ ID NO: 24593 - protein, 68 aa, Candida albicans
IRPRIINRDGTLKFQTSVQLVELYKNLLKNDEVTITEELANAAYFNGMSELEGIIEKDKQMFEDTLNS

SEQ ID NO: 24594 - protein, 214 aa, Candida albicans
TTNSPKILYSGIQLFNHQYCAITTMEETIDRIPKLKKNITELRPEIVDKMERRANLSILDTFASSNIYSGTITSAKSINVVRFIDQSKGNDSFRDGNVFCNQVEVFKSTIQNGLRSICECLKINPDAHISEQEVVCVIISGIKALQLKYSLELKTNTQLKNDNETLIIAVNNQKADAEHIANENKEIKRQNHDIYKTVTMLDRDIHQAAGRNHA

SEQ ID NO: 24595 - protein, 208 aa, Candida albicans
GFFWGGGFPSWAGTALVAGLVFLICWYRRKKQDEYDDDVDDQFTLSGPKQEMEQHPYSTIGGGGAGGGGGAAMLDPNPFLIAGGYNNFDTSQQQTPRQQIISNGTVTGSGGYGHNHKISSSGTSGDGNHSFGSQTDTEFAFYDYSNSNNNNNNNNTTSPNINNNNNNANNGLLHTDSPNPEFGRRRLSNGSLPDMIARNPGSLKVVNN

SEQ ID NO: 24596 - protein, 76 aa, Candida albicans
PIIKSFFCLPVSIAQNQRPQNKRNATITILNSVSSLFACFSTCASSSLLTRLPSSLLIHSATTATTTITIATTAKH

SEQ ID NO: 24597 - protein, 77 aa, Candida albicans
RRMFQTDLLNLKFLKRKSIKEKFSGENFSLLVVDNIRRFLLELSCKMLTILLHSEQMIDILNNYHKLINTSEIRITD

SEQ ID NO: 24598 - protein, 67 aa, Candida albicans
FITCVEYNLLEHQRSEISGKERKKERGGSVGGQEGKKLEGKKKQMRRYLAGKKTKIWKWNTPRKKKE

SEQ ID NO: 24599 - protein, 92 aa, Candida albicans
NRLILLFFFLILHNFQFHHSKLINPILICFPPFFLFVFGLSPILWEIDCYIYIHTYINQLEIPPINFSSFPIFHINYLSIILIIAWNFCYFD

SEQ ID NO: 24600 - protein, 340 aa, Candida albicans
LSRVHVSRRRPIQFPLKLPKPEPKPKLEPKLKPVSKRVSPPVAKSATSSKQYKTIKPNVQKGNTPPTRTAISTDQVKKFQTNFHLNPVTNQTSPSKTSITSIINIDDEPIPAPVSTPTSANNSPGNTNTNATKRKRANVKLFDPKKRQAVSSITTGETTATTKKKSPERQDRSASQVKLAQKSSSTTTGGLQKSPLLEKKADKTASGNSSSLKKQLSSLGAITDKNDSPVPVKLSAPSVIDLLNDDSEPETSQTDDKQSAQGNNNDKKIEGNKEPKQEETQISKKEEKPTPREKEKEKEKPEPPIIALNIPLLNPKDPQPGKAEVIVNVLKLAEEKYAGG

SEQ ID NO: 24601 - protein, 64 aa, Candida albicans
EMIAYVFRKLISVLFFCCSDMHALPSSPNQSIEQLTLCAVKNDVKKNSSLKKREENNMQQPIPI

SEQ ID NO: 24602 - protein, 137 aa, Candida albicans
RPGIVNQLQIPLTTQLGVTCSKFIKPPSPNSNYTSLLKQTQQHFQFELLLFSKSGIEMLLLFFYFVAHQVGLEELVEICCKTGSAIFYVQSVQIQFREFDESFIIAILLFSVLYYFSYNNYQTFTIIIIYRSLASNL

SEQ ID NO: 24603 - protein, 66 aa, Candida albicans
  UNSURE (12): Identity of amino acid sequences at the above locations are unknown.
QNLNERDSRKKXRKDYANNVMQLLLHYILLPNNFYNLPKTHQIHYHLYTRRIIKRSKLATLLTTHL

SEQ ID NO: 24604 - protein, 68 aa, Candida albicans
IIFTIASNAFLDNEPSLLKTDVAVLFVAVAVVEVLETDVVLAVVVDDNDEGSNWDTPLLSDCVLELPA

SEQ ID NO: 24605 - protein, 125 aa, Candida albicans
PTCHFLLLNHLLVFFCCFHCTLISILITTMADSTFDEFFDNDLYSAPTSINNSKNHVKNVRNSIQIKHSKSSRSLNEFTKDIPPSATTSNSTTKSNTQTNPSSFKSPRNTSRSIFTTERQDPRIV

SEQ ID NO: 24606 - protein, 208 aa, Candida albicans
ITKNKLAVDTCLLRQKPDEKYDSIAKEGTQQYDTAVQNAQEQYKQAQEHVSKFADDVGSQATQTHKKLEKDYVTYKSKIFSFLTNVYRGIMYRLSIFNSNAYDAAKSTGDVINNQWNSVVRTYSNADLKAYLRSFGYSYDWLSALNRRELLSLATFQNKLFSGYDNLQNWEKSVGEVLNDASDELKIKLGLKKEPKSLIAKLKSVVGF

SEQ ID NO: 24607 - protein, 76 aa, Candida albicans
RVVKVIQELELLEKLHEHNEISFNKFEKVVDYCKDKLEQHELIMNNNEAGSGVTSSISDLITVDYSKYSIANTTSI

SEQ ID NO: 24608 - protein, 71 aa, Candida albicans
HKNQKKKWKNSAAHQEVEKSPQQQLWRTEIKANSYDHYTLFFCSLSFQDYTKRSEFSLNILQNLFQGGDYY

SEQ ID NO: 24609 - protein, 78 aa, Candida albicans
RLVIEKFSIRVFPAEWKLKFWDYQFRETRICKGLIEGNTIFKIFLKNSMEYSGFKTPLINYHWNSHYGHKHSLGKWIL

SEQ ID NO: 24610 - protein, 353 aa, Candida albicans
LKRQCIGFNNDKQIIVTAWDSLSNDINVYCIEINWGFLVESAKRQKLDQHYHTPKEAQKPPRLTLKKLHQMKPIQCFKEEDGESQSQLVVPEMGKLKVEELSSIDIISSNPDPKSGLSILITYGSSIIYRYALEKSDSSNTTSGGETSKNPISQAFYNLGVEKKIDWKGDDSSVRLVFKDKLMRRGQIESIINGFLDLSFLIIYKDGTVDVVDTTSWQIVNNSKNNNSVTGDEMELDNNDYPPKLISNLFDQGFQFPKISHKNRLVLAISPTMSSIVYTEIYGETVNLQLKPLERIDNFGTNSHDLYYTSVAFAHRYAFALYTSTCSDDLLLLIQSEINRIKDAVDGRYHYSK

SEQ ID NO: 24611 - protein, 89 aa, Candida albicans
MGDTITRNKLGKQLCDLVIIECHNAINFHLDTITKESLDKLLSNNASLQKLLSLQLILGEFQQLSHFPNNYVVPDIAWIVWNLPNAVWG

SEQ ID NO: 24612 - protein, 91 aa, Candida albicans
  UNSURE (65): Identity of amino acid sequences at the above locations are unknown.
LSYPCFEGESIMVFSYPITRQYLLIPSSRPNLISLRKKKLVCVNRYTYHKGSLKKIFLLVKVENXIVLFSIDITTPAQVGRISTHIMSTKG

SEQ ID NO: 24613 - protein, 60 aa, Candida albicans
TGSPCIFNLYIDPKQLSTGLLISVVGSGFFFASIGLRCIMYITLNQHIYLNQSFISFDDA

SEQ ID NO: 24614 - protein, 136 aa, Candida albicans
IMVKQYIPEEAELNPELYGLRRSHRERRGPAIVESDSEEDVAPSRKKKKVQDDYEDGISMDEDENDEFGDDDDDDDDIYYDGSFGAGKKMKSKPKTSKKQRVKLPCQEKLTIAFASTKLYISSKTHKHVNYSIEFE

SEQ ID NO: 24615 - protein, 64 aa, Candida albicans
VFLNTKTTSAIKYSVLPTVLVVYFVLARRLLIHLLPNNANTPLSRWLCIGSLSNIVRNNCFFLS

SEQ ID NO: 24616 - protein, 61 aa, Candida albicans
  UNSURE (4),(41),(44),(49): Identity of amino acid sequences at the above locations are unknown.
IDHXAISPYHSSYKNYTQIPPPHHPEILHVFSKLLLSVANXIEXFLVRXGSASNIIVASIA

SEQ ID NO: 24617 - protein, 89 aa, Candida albicans
YADFGPWGKHQVCDLDYLNCSGIFDFNCPAVYGIELSGVRQSFNICVSGLESKKQGILIELSGVRQSFKICVSGLESKKQGILIKHSQN

SEQ ID NO: 24618 - protein, 60 aa, Candida albicans
SRFCTVSAENPSLVYLMQHIGSTEMSRKTDQHQGQQPKAHKEELLDKKKKKRGCKLETAT

SEQ ID NO: 24619 - protein, 60 aa, Candida albicans
GDRLSRFETVLLFEFYFKLAQNNTSSYIHIIHNYKQLGQLLLMKVAKKPTFTYHCKRISY

SEQ ID NO: 24620 - protein, 69 aa, Candida albicans
QIIRYEKDNCENEIHVQVKSGFEKGIKSNEIVICYLKETESSKNSRLSQIYADIYIYIYIDEHVDHRLN

SEQ ID NO: 24621 - protein, 84 aa, Candida albicans
IHFIIKSTNQSRIEKFEKIKINPSNLIVFLIKHELIGFSISIMHIGLIETVKKIKRFGHHVVVALVNLAAITYLIRCHQLMFQS

SEQ ID NO: 24622 - protein, 151 aa, Candida albicans
  UNSURE (32): Identity of amino acid sequences at the above locations are unknown.
MKFKFLSNGSFFGAFSRSHWKVVILHIRFLIXHVIESKGVGTPPESITWIRGAINKEFLAGKVDVPKGEHLLNVELPDETIDIIQNFTTERTKAFIEARNNLPEVKLNNNKEAIAKEQFQNLIDLKFDQVNGYFIEDRVDNYEALQKLAKL

SEQ ID NO: 24623 - protein, 81 aa, Candida albicans
IEYIEVTQNESIEWEGKLLKVNSGKKVIQLKVYFFPNCQICKLEIAHEVRTYKTTILHELSDQQTRHQGSIYNFIFFKGSL

SEQ ID NO: 24624 - protein, 76 aa, Candida albicans
AMMSKRMLLLQLHPEKLSRRTLLLRNQMLLQLQLTQPRLRRKKSPTGNEAALKNKNFNKDVAPPQSTGYQTLQETI

SEQ ID NO: 24625 - protein, 80 aa, Candida albicans
VIVYIYMEIGMTKKKNKNNSSMICIDISIISNSSIYKRLSLKTKELKKKYCSFCGSNTVPPDFRFEILQSDALPDELKLQ

SEQ ID NO: 24626 - protein, 79 aa, Candida albicans
FKYFANPDYDSLTVYIIKLSRLISSYPIHSPRLVSTIRRNILNMSKYYCPDTVLSHYLARFVCFKRVYTNNRKDVVLFP

SEQ ID NO: 24627 - protein, 334 aa, Candida albicans
RQRRPTAESQTFDINSSPIKDSRTATTKTRTPSVVSTPSQTPARTPTPTSTSVTTPNHLISIIPVSKELSRMTNEMKQMIDSMKKYNEGYVVPTTSSTPVSTNTEKLFNRKHINGDQGGSKNNNSTGGSVSVNSIKHNLEIENRWYKNMYVVSDRLNFMKEVYKAVNKLKEKKIAAEAAAATTSTTTADDTTSTTVPAATTAETATTTSITTPTSNNDNINNTDHDKELKVKEKIKLMMMMGSSSPVKNEREEYTDNGLSPVKLSALENNDSFGKNYNDEDGDDDEEDNEDEDEDDGDDSEERMGFDSNSRRRKRRHRSNGESSNGDIVDIKGV

SEQ ID NO: 24628 - protein, 104 aa, Candida albicans
RNHFETIHIHIHTFKTRHKIMKPVVSTFQAYCCFITSSFAIVILSVIGYLFQTNSESFMGSINDPEDGKAVAKTVFSAVFVYLAFFAFCGLQILLIQRQSSIQL

SEQ ID NO: 24629 - protein, 85 aa, Candida albicans
NGSFEIGFVSNRKSVRRVSVYPPANSNQFCLVVHDYYTNHLIEADSSNSTYNSTSNEIETARNQGGVNFLITGRKNYNNHLCGSH

SEQ ID NO: 24630 - protein, 310 aa, Candida albicans
RLVNKAPQAREDELFGTSIPRPMGVPKSDSVGQNMTAGLDSKSELPVMLFKVQDRDIQRDSKFFDNSNSHGQRKSGGGDGGVGGEDENQSLSGCDSESAGNIRESVSGSVSGSGSGSGNGSGTRSGCSSRGRLTIGSLSEAGNSSRSSGSSIKQIISRHFRSIGESLNTDEKQPQPESNSQDPSQQQPLRSLNLVKDSPPILFDEKNHIIMPSSKFDQESQQEPTKQTIDYPWINWSLLMLLGLIVPPLYFVIPIGLMDRDYLGLRYANKPSKKFTTTQKIISLILGILWLLIVLAMIGVGIGLGVTRES

SEQ ID NO: 24631 - protein, 64 aa, Candida albicans
YWNKNISSFSRMLELKSKRRLQNQVNYFLSIDIRYYFLSFSFIFVHFRSFSFIFEAYIYRVYLR

SEQ ID NO: 24632 - protein, 63 aa, Candida albicans
FSPRLSCPALKVALALIHDNNPSTLKVYAYYLAISMVSSNQSAPTYKRETKFLLTIFNKINYY

SEQ ID NO: 24633 - protein, 220 aa, Candida albicans
  UNSURE (40): Identity of amino acid sequences at the above locations are unknown.
EAKTLPRLQTNDPNHNFSKSALPVMHPGPTVEIREFTNIXAVPNVLPASKNENEKEELTKDTSSDGGCTGNPGTCRQCQMDPMSTLFCTTVASRSTKSDSVSSTRQSISRTNSKTSISIDSLNNPQSPIPPPLLANNKTGGSNAPTPTPAPSTPSHSSSVLSNSGIFIPCADAYKTLSRHKKFNSVDFTTLVGKLTTRGMQVEVQSVANVLRELDRRAYN

SEQ ID NO: 24634 - protein, 60 aa, Candida albicans
ICSIIVLQLIALQLLFLYNYLEAVTTICIQKTQKKGCNSDTILKIYNQLTYWLRQIAHTP

SEQ ID NO: 24635 - protein, 129 aa, Candida albicans
KNQPPIRIDNAIEIFQDTNLTNGFCVYRNNGKVTINSQSLMGTKVDLRDYKFKFDERFPTENKFLNGSLQSLQQERHHHPRKSLSIIPSLNNNYHYRVYKKSNNSIHKVTKPDNYKKKDISTSKVSVKV

SEQ ID NO: 24636 - protein, 112 aa, Candida albicans
NRLFKSIRDNILVEIKVRGIHIYYTNIQIENNRFLDEKLIFSYLIHFAAIATYRKKKNTFSCFVLSFNNIKYNNFNLVQKNEFVFFRLQCLMNHVIVFSHINHKNRFIITLC

SEQ ID NO: 24637 - protein, 66 aa, Candida albicans
CYLCTCKVQLLYELEILFIEKSNRKTLPPPINIIVLLNKLVRKSLNPDKGDITIIINTSTNISNNN

SEQ ID NO: 24638 - protein, 78 aa, Candida albicans
MTSLAILPQLKRTITDIMDEELYQSPSSPNSMTSFPSGTGNLMSNTNHNTFNQSNNTPFNMNYNHISNRNSINSSPNS

SEQ ID NO: 24639 - protein, 71 aa, Candida albicans
YCCCLLSRSITSVNMQQVYLDINLLVVQIRKYLLSASRTCIWNFCDEEALIIIADVSGCVYNNSNIPLIGI

SEQ ID NO: 24640 - protein, 73 aa, Candida albicans
YGMIILQVIYVFNVDIMRVIKIEYGENRQKKKNMVSYKLGQVRLFFFRQIGTIKSKETKGSEYNNCSHNELSR

SEQ ID NO: 24641 - protein, 401 aa, Candida albicans
  UNSURE (392): Identity of amino acid sequences at the above locations are unknown.
ICEVVIYLPRPFQYLCNDDRTTIILTEKTTMNFASSLSSVLYTEWDSLAKKRGGGESEDGIAVPIDKNISLKNWTKEVELTGTELTEFQEKVAQKRKEKLLAKVRDQKNQNILSADTVDSEDSSDDDDEGDNEAEKQKGNTSSNLLIKQYQNINVADSNVAPNEVNPLATHEAFITDHIKQSLEKNLPIDLKITHKLRPRQATFPYFATAHKQKFDDYGEVIKIEDYQRHDEVSHSKIIMEGKRKFDEKRTANNRRNKNQNKQQANKLTPQEQVNRKLLQKYLDTLSNPKKRVGLNYGTKKKSETQKLKVRCGLSFVDLSGQVDLRSLGIIVQALKPYNLILLPDYTPLQNLTRVQEFFANQQNEQLQEQTKKNLAQSSRYLSLVSIRDGLXQCHVALFKW

SEQ ID NO: 24642 - protein, 119 aa, Candida albicans
GKSLIRIPRLFEKMEYEYTGGVHGKETPLGRTFKYIKRGITILRSEKGTAQRLRRDTINDQFQEHILVGELRQQMIKEGEYTFARYSLDGINTTHEISGVTQADTLLKYHTRVSVALNP

SEQ ID NO: 24643 - protein, 69 aa, Candida albicans
LDSNVRQVNLLLLHYLIILLIVFTSDLLYELVGLIFSSLILQIFRKMAKNNEPPIFQQQKISSYQLNTS

SEQ ID NO: 24644 - protein, 118 aa, Candida albicans
PQTPKMAFPLDQSDLIRHLRTTYLVLNEDSDYARRIIKHSLLPIPSNENTPRTPFSESPPITFEIARHIQKSVHNGLRYDDPYSSQPNFSTSPGKGSKKRGKKNARKRVKYLRIQNYK

SEQ ID NO: 24645 - protein, 83 aa, Candida albicans
EAVGEKVQSMKSTAQLNTQNKPALSFGSICAQIGNNSKQISCSNHYNKIWFDSSLHHQQSIDSLYPSLPFKLFFINSKIHLPL

SEQ ID NO: 24646 - protein, 67 aa, Candida albicans
YYYYYKHFNIFVPMENVGEQPTSLIYYDYHYPSFIRKKISLVPNGLTKYFLNYVCSIFNNCLKTPIV

SEQ ID NO: 24647 - protein, 72 aa, Candida albicans
SFKNKSKFSCCQYKDLLLKFVIFVHRREYYRELSVTKIKDRLSNAYLISLLFLKITRFLFKDKFFAVSITQV

SEQ ID NO: 24648 - protein, 104 aa, Candida albicans
QWQYQFQSNHNTHYNNGHNICGEINRGCMKKGNALQRVILFQAQVINTGQMNMKWEVISQSFYNNNDNSNFIVRDNLVLILCYIRMNIFGVINCCFNLILYSVC

SEQ ID NO: 24649 - protein, 98 aa, Candida albicans
KIIYNQDKRTFLVKENYRDGKSFFFPINQKSYMSQVNLLEFQDYLLYSESLNILIESEFSSMSLDTTAFQPSPTKAPEASMDLGTIPKRSPARFLHHG

SEQ ID NO: 24650 - protein, 70 aa, Candida albicans
EQEAIDETTEDADMGVLGMKTEMRCRFPIRSDFDVVEEFDSDAAPSSDDDEEMADSKETDDRPPKKKAKN

SEQ ID NO: 24651 - protein, 65 aa, Candida albicans
FLFLSDIVVVKSNFLELEMQITTYSTIALQEKKSLLQGACLQVYLLLLLSNSANVYLMVTMDMYL

SEQ ID NO: 24652 - protein, 74 aa, Candida albicans
QLMIMRSPVTLVKYNNYLNRESNRGRIKTMYKSKKRLQNSKLFTRNRIDIYMGDIQSLRYWGITCDFAGPLTQF

SEQ ID NO: 24653 - protein, 70 aa, Candida albicans
  UNSURE (56): Identity of amino acid sequences at the above locations are unknown.
ARLIATVNGKKIINRVGTTTIALCNQIIGEYFYSKNKLLQNTKIESCTTYSEGELXKQYEPQYPWNFPPL

SEQ ID NO: 24654 - protein, 69 aa, Candida albicans
  UNSURE (49): Identity of amino acid sequences at the above locations are unknown.
KISYQENLVPPPPPQQQPLVLVITIMDMVIMQLMVIMLPITFNDTPHTXTFFLTSILQIPSPPHERQYI

SEQ ID NO: 24655 - protein, 62 aa, Candida albicans
LQKKKKFIATKCNYLIGVRRRRRRSVFFLQKTGRAQISKTPHYQINQSINQRKLRSCVVVIN

SEQ ID NO: 24656 - protein, 61 aa, Candida albicans
NPILKKMMIAAKKKKIYSNKMQLFDWSEEEEEEECFFFTKNWSCTNFKNSTLSNQSINQSA

SEQ ID NO: 24657 - protein, 221 aa, Candida albicans
  UNSURE (220): Identity of amino acid sequences at the above locations are unknown.
SFSEIFGSNQNDEIGNFHNKKKKINLVPTQKKMENNDSLYFTNLKHRQQQQPLLLLLTGLIQIMTSDKPSFHKEGKSTIKIVHDNNKNNNTKQHKRPITPKDISSQSQKVKDSPFVEELVLTGRPNWKKAPQQIKQRYKGIYLILLSIPIMGITTFEIIRRLEGKSTKKIQQGERLSNGINREFDEQEKIKVEKESIMYKIFGKEFFLDGFTSKTIKSTXE

SEQ ID NO: 24658 - protein, 200 aa, Candida albicans
QQLNKLVCFDHAHFLSRLTPDSDLVYIATDFPRFLPPRMALRNYLYAKHDHDTSIDIKINKDNSLMSNITEKVSPSSPSPSDPSDSQKQQRSPMQIQQSRRRIIRIVHKKSSNKLKLNPLVNSIEKLTNNIENVHIEKKKKENCLNDCNLCDCKNETNDNEKDNPLIQVEVDNRVNSGGVGDGGHNEIVSNNEIDFTSSL

SEQ ID NO: 24659 - protein, 114 aa, Candida albicans
PQPSFSVVSTNKNSRRLVTIFCYLFVFYSPLFISSPFTTYSGIMKDYLAMFQAYSHQISKLKSHFFPSFLQINLIKTVYRWIINLFSFFTIQSLWYTTYPENTLNFFFLCCAVF

SEQ ID NO: 24660 - protein, 83 aa, Candida albicans
SKRNYCSEIKLCLSFSKRDPRSVILVVEARVSINKIIIWSHNGKCSPRKLKTDKNNKIDSAVPHVSFVIPPHIIRFLIKFSPL

SEQ ID NO: 24661 - protein, 93 aa, Candida albicans
CCSYCIVFNLFFFCFLFIYMCVLYSSNVYFYQFMKSSLSILRSDISPVFYGLQNRGGEKSRMKGKTKKFSIFSRYQTFQISLTQPFQQCLILN

SEQ ID NO: 24662 - protein, 65 aa, Candida albicans
VKKAESVKMLLSIFLLVFVHYCYQFAATTTATTFTTNNQLEQGSELKDNQMVMRRNGKHRTIFFF

SEQ ID NO: 24663 - protein, 86 aa, Candida albicans
PITGNSFAYFLHPKHHWLIIRLYGIDTYLLTNSSRSMDIGFQITILYVRFVVQTPKFFFLASSMDALFFSPYLRFDVGFAVNTEHT

SEQ ID NO: 24664 - protein, 84 aa, Candida albicans
  UNSURE (17),(18): Identity of amino acid sequences at the above locations are unknown.
SRYLTFIISHLWKEDEXXIFRRMKNNDKGGITPNPMATVHNARRCFSVEIQIKTNGTKAETTKPRSIMALVNQLKYLFLLPGGN

SEQ ID NO: 24665 - protein, 86 aa, Candida albicans
  UNSURE (8): Identity of amino acid sequences at the above locations are unknown.
YKRDTKGXKICMVVEILLIKEQQEITISLRNEYDKQNMDNLVNIDPDYSFFGAGNNDKEDDLESTVTTSVSQSQTQSFNDLIGLQF

SEQ ID NO: 24666 - protein, 68 aa, Candida albicans
GEQRRKKKKEYRYNMVAINSLLFAAITLVSSAQATDTLTIYHNNKFAVQACKGLIGKTAVLIVFTHGS

SEQ ID NO: 24667 - protein, 64 aa, Candida albicans
IEEGKTLLVVLTSKCSCDNNKHNTTEDLKTFLFLLINVEIFHSQNLKILLELLLLKKKKTFAKI

SEQ ID NO: 24668 - protein, 109 aa, Candida albicans
EEEEEGEEEGDDDEEEENTKDKSNGKEDIDRNKDSKEDNSNANSTQAVKNKLETKLKENEHSDEKSDPTKENSKDGKVSKENTTNANDSINEKLTTDDEPIVPTTKSDE

SEQ ID NO: 24669 - protein, 70 aa, Candida albicans
SGQLRVENTGLVLGVSDIDTWDILPEHKNLDAYEKDGFRFWTDHNSGPSKMKDHNSVQYLNDIKTHLLSL

SEQ ID NO: 24670 - protein, 99 aa, Candida albicans
RQLQDSNLRGQSPKDFKSFSLTARTSCLIFCKTIDMHFLLSTHFSIINSKDTLLVAGNALMDQFSSTPIPTLYENKQNLLFSLCLGWDDSATHIVDTQS

SEQ ID NO: 24671 - protein, 337 aa, Candida albicans
  UNSURE (39): Identity of amino acid sequences at the above locations are unknown.
KKIFFPPFWEITFNFLIITNFFISMLYSFHKMIWHLAGXIFFFSTLISGFYFSFLTLGITQAKGEILFDMVKIFFGFTPSVWNNWENYNLLGKFTLMGYLFLIQFIVGTILAICLSGVFAKVRDSNQEEFNYFKTTNLILYFKMARLNNLNNWTNSFLHIFKIPIIVILFGYELIKSKSFHKQISSELKNFTFLKQDEDNIQGTGHEVDGESNIMGRSTKRRLSRRYNKYQSLSTLNGGNIRTASTDSFFINELLNKRYGGKIEKVRTNTSERVISRKFLQQPFAVPRQPQPQAQHQQPLQNIQTLRQQSPPSIISSSPHSNRHNNNNNFGTVTDNI

SEQ ID NO: 24672 - protein, 77 aa, Candida albicans
TRLNNLENNIAKRTLMSTSVDDNKSIMMYNINEIENNDSNEEILINSQEMDSPEDEFESSKDNTMEDIDQYDSDETF

SEQ ID NO: 24673 - protein, 124 aa, Candida albicans
RKGSVPQSPIRPQSPAETRILNETRIPVFKRKSGSKPSVASAPAPATTSSTSSFSSSSSSTPEVGPATSPTKPQAPPQYMNKHDFMHRSLFRRRGSNATDTSSVSSVSSRLKRTSRIFNWIRNK

SEQ ID NO: 24674 - protein, 74 aa, Candida albicans
VNENIHKDNSLFMTIVIVKMCYFSCNSTYMNHVSILTIKDDLALKHKCKRRVRRKKKQTKTINSQFENRTIEFS

SEQ ID NO: 24675 - protein, 76 aa, Candida albicans
YYNLFRICKIMITVMVKYIFNSNFFSLTKPLRKCFFRLKFGTKLGLKLALYKNLEMMMMMIIPSCGGTVSKVNACE

SEQ ID NO: 24676 - protein, 98 aa, Candida albicans
KKACGRVICYSHTYVTSSLEFFFFIYFFYSLNSVNSGIVSKFPMYHVLCQFFRKRSNGIQTIHKSTTTRRQKKGRVRKKVKLKQNTNLKSMLLLILGN

SEQ ID NO: 24677 - protein, 64 aa, Candida albicans
IQNVISRMLKPQTKILDRTNSVSPPPTPPVGERKKIPKKRNGDNLTHYTWRFGYAALVGSFGNS

SEQ ID NO: 24678 - protein, 99 aa, Candida albicans
  UNSURE (90): Identity of amino acid sequences at the above locations are unknown.
NTFSETFQINQFNSVIAPTNIKMSSQADYDKRLAEEVGSLSTRLVTAVNKQVELEETILELRKQVSALKLKNEQLNQSDIKLKTLLPPYXYTPDCPYGD

SEQ ID NO: 24679 - protein, 85 aa, Candida albicans
SIRIILNDDKSIICQKKVNVRTMPLIRNICIFFCSPHIHYKGVEMFSKISVKRPIINSHQSTFPNKKCTHENVTPLSYLYKKRDR

SEQ ID NO: 24680 - protein, 81 aa, Candida albicans
MYQIMFTYFIVVETELNNTKEITPSIIVNIVSFSFVILVLGGILLACFVATNSQTNFCSGDFFCCCGQFFFRWKNKQMRNC

SEQ ID NO: 24681 - protein, 63 aa, Candida albicans
IWSCYQNVLIHLMPYTNLEIMLKTSPRGQTTQLLSSLAQKYKIYFIGGSIPEKGENDKITIHR

SEQ ID NO: 24682 - protein, 68 aa, Candida albicans
RAKFEYQYIWYEKCFYNGEWSGWCGCCAFFHIYVAPNHQQKKAEPVTRCIKQLDIKRIFKHLIYNLIE

SEQ ID NO: 24683 - protein, 80 aa, Candida albicans
INKLTNFCAQYICPTGRVPIITMPMKNAIIARNITTADGTFINNIAPPIAATTPIGPHGIIFTPDITALSLSTTSDHLSV

SEQ ID NO: 24684 - protein, 258 aa, Candida albicans
KVTEYGGKKYSVLSNESIEIDNLHNKRKWNEIYGDNKQDQNDDDEDDEEDDELEYDEDKEEHPLKKSRIIELLSPLNHPSEIISHPAISKTYKLQTLSKLASELIDLIEIEQTNLNWLNKLLQVLNGEDWFYLLEENLGLKDYDHGLDEDKKKKIEEKENNNKDNTVVEDEFEDEEENKADPFFALPTALKRYETYQQNLESSDPLKEELINYLQVSIQRQHEYIKNLILLRNGLVRADRLKSDLYKWGKEMYEKNSS

SEQ ID NO: 24685 - protein, 88 aa, Candida albicans
  UNSURE (79): Identity of amino acid sequences at the above locations are unknown.
QFVFIEIKNLVIYWNYIIIIIKKNKQYKQYIYSLKESLNYKLRRKQANVAKNLCCSLNKSFFSPYYHHSSRRAGNNRRXGGGEKKKEG

SEQ ID NO: 24686 - protein, 127 aa, Candida albicans
IEYTEYSCFFWTEVLLMTNVNLITIAIAIIYFSIVIVAIVIPKSTYNITYQGINDIVRYGKQMYEFNVIGGPYKTNVNYYYDSNGLYFIKPNQHLHHDSDDSDDMVEVLSRDELGLQLNEMYNSLFL

SEQ ID NO: 24687 - protein, 87 aa, Candida albicans
VVSNPCNQIYTWNTLCFNNHILHQMNLYWLFFKSPSSPYNNTQTTNQTTIERSLSITNQSVTTNNNVDSSECLGSTSMGSHSWQTMR

SEQ ID NO: 24688 - protein, 61 aa, Candida albicans
LKITVSPGLLLLLIKTFLEVEHYFYNHTVLSLKKSLIDKVIWIVMRISRYKCVTGLCYFEK

SEQ ID NO: 24689 - protein, 114 aa, Candida albicans
TTRSINNKEKYKKSIDKDKDKRKDVHVALCLNDVINVSIYILNVLKLHKTWPYNSYFLVLQFQFWVHFDGRLILRDIHWFLKILQSDLPLSYSDSPVKSFLSSQIHQEKSTSIS

SEQ ID NO: 24690 - protein, 60 aa, Candida albicans
LTLKNNSVALHTFQQSLYFNNNVYDVYSTRHEIDLPSPYSDSPTYIHYIQGLISKNLLYL

SEQ ID NO: 24691 - protein, 61 aa, Candida albicans
TLSWLLLMKILNSFSWEIFCQFFSSLYTGNKEFFKLVYDNNNHSYSTITIYQLHIWRERAA

SEQ ID NO: 24692 - protein, 63 aa, Candida albicans
NNKLYFFFNLNQNRCNVMKRKTIPSIRGYWILKSCMKLRISGRLRVKNKKKKKKSGEKSKVLS

SEQ ID NO: 24693 - protein, 78 aa, Candida albicans
FCRYYIFLIYFLSYASEFCALFRCRPRRTKEKKGLKGLSCSHDISPINSGHTLTVSFSTQSYTYSTGEESLLYIYKSI

SEQ ID NO: 24694 - protein, 62 aa, Candida albicans
LFEIHLYINCSSSLLNNYLINGPNIGCFYYSFSLFIFSKFEETQFPKMGFAETNWVHVFQIK

SEQ ID NO: 24695 - protein, 103 aa, Candida albicans
HIELNPNCEVNLPLPLPSNGGGGGDNNNNNNNTKNGSNGDSLIDEEQDQDQELELEEAPSQIDRKLFLAAVGQVREVLHIYGINSVTIQPEFLNSKKVCRLIF

SEQ ID NO: 24696 - protein, 65 aa, Candida albicans
LLLLLWLLPPDNKLPTNPAAPDPDPDPLWCLLEPVTLDTTWFMMNDWTPPPPLPWFLEPVALEIA

SEQ ID NO: 24697 - protein, 257 aa, Candida albicans
KIVAFLDAIYESRCQFFMRSDIEIDYLFFPDVLNSDNKELMDYVKSIQPESGNENIMEVQDEEMFARTSIDMNNPYRPNISTYDQSYTKSFDDFKSAQKENINNEYMNTRAFTGDDEKFAFKRAVSRVKEMVASETWRLNDRWVPLDHTMRPWESPTAGNNNKAKNSDYLVTDENQKLDKLLEEKGIKNITLEIAESLPREYSRGQGVLFRLLNSRIAPIFDSLQHYWAIGKWSPENGKRLKDSIARSWIRSSVRKK

SEQ ID NO: 24698 - protein, 166 aa, Candida albicans
LTIYPNQFQMSNDNTVQVNKPETLASILEYLQQESIFSAEDKCSQDEILKDCPQFFVNDPSKKLNWQQLAECFEDVFTKYTAETCELKEQIEELVQVRPISFSHYWHLNPLLTLICSPNRNEKHYLKVMKSSIRKELKLGKFKRLLVNLSFLFSHINSIILVLKNH

SEQ ID NO: 24699 - protein, 175 aa, Candida albicans
  UNSURE (169): Identity of amino acid sequences at the above locations are unknown.
PTIVYIMSFNTPFSEDLERTATNDSHRYKDYPEFDSLSTSIEKQLHYINSELLSSIRLDLAKFEKDKTDTSLSESLSGQFRKTTDAFKKVNKFVKLLNASIVTTEREHEDVETINYLKQKEAIQIKLIRDSLANFNNFQKRFELCQTTQLPEDGTNLLETEPGFFTTPXADPCRK

SEQ ID NO: 24700 - protein, 64 aa, Candida albicans
TYTSQHTARYRLILFTLTLYEYLQIKRRKAKRTDSLILRKWETITTKQGFGVVVSLCGSFKSNL

SEQ ID NO: 24701 - protein, 146 aa, Candida albicans
NLQLSFQILIYISFFPIHFLFSFLNSINNNNNNKLYILQVIMSATFIIPQSIREISANSTTINETTSNPTSNTPSTTYTELPAQGYLARISNLPAVSAINGMKSSFPVVKIFTSNAVPVLVARQERKKKEEMERLAEYQKKLNMPQ

SEQ ID NO: 24702 - protein, 60 aa, Candida albicans
YSANRSISSFFLRSCLATKTGTALDVNILTTGKEDFIPFMADTAGKLEILARYPCAGNSV

SEQ ID NO: 24703 - protein, 111 aa, Candida albicans
LWYKLKKQAQAAIYHQIMLRTLLLLLVLSFPLAFSLPDQSQSCVTNMNIPFTGYKIEYQLNLQRFEGSYHLLYCNDNKLLYDVNLNNSIPWTLPINFSSLFFNHGAGRIRA

SEQ ID NO: 24704 - protein, 60 aa, Candida albicans
TSKIPNEINAPNNEIKYHTNPTSGKIPKYDNVNKKNPNNVNTLPTNQPNCNVWTVLSNLS

SEQ ID NO: 24705 - protein, 84 aa, Candida albicans
RRLRKKKQQKKNQKKRRKRKELKKHLKRKVKEELKEEPKEELLEELKEEPKEEPKFAVPPPPPRKAGRLKRLKRAIKDGLDEFD

SEQ ID NO: 24706 - protein, 61 aa, Candida albicans
RLSRDIFDDDVEEEDEKEEEDEKEEEGMLLAGLSSVRCFLSLGAYFKFIIIMVKLWKISQQ

SEQ ID NO: 24707 - protein, 60 aa, Candida albicans
LKTNQAKQLLQKEKENRINYCKIVRHKKKTIEILIKKKQEPFTCIYMIRSITNNLSCCEE

SEQ ID NO: 24708 - protein, 71 aa, Candida albicans
KIHISLYHSPPESVFVLGGSILLNRRLYLLTEHICFALTHPLDTIEFKSFEFATNPFSVFYYKIIANISKN

SEQ ID NO: 24709 - protein, 93 aa, Candida albicans
LFCLVGLQLLHENMNNTKNSENHTSSVDDTIGTILPSYSMFTSTIGMNVNVPEDNYQRYTDAEPPSYNQEDLNTVESSSVSVSSSPSGWKDNV

SEQ ID NO: 24710 - protein, 75 aa, Candida albicans
SNKTIKKQWFDFYDNNIYKYYNIWELCTNKINTIEKIITIENKLRTQFPSFSALRTNVREKALLQKTNKPRNLIM

SEQ ID NO: 24711 - protein, 96 aa, Candida albicans
RIGSNLDGKFRTKSLTVIATENNTAVPIFIKPPSPNYQMKSYIIKFLGLLVFCNNAFSRTFVLSAEKEGNCVRSLFSIVMIFSIVLILFVHNSQIL

SEQ ID NO: 24712 - protein, 76 aa, Candida albicans
  UNSURE (66),(73),(76): Identity of amino acid sequences at the above locations are unknown.
TPFVVVQEVLKKENFVAGDYWVVGTSVAYLGCNSSCVVIQMGSSQKAYTHYNDVNTLVVVAVIFLXGHLPYRXIYX

SEQ ID NO: 24713 - protein, 74 aa, Candida albicans
CVQFKSFPQKKKIQFRKIRVLNIKQLYYKYPKSKSINSKKTTKPVHHNKLFDVIMFRKDVKDLSLEFCHHVVNM

SEQ ID NO: 24714 - protein, 84 aa, Candida albicans
NDAKQEGKKIFFFLILYNQNFNISQSKIKLVLPPQLELTQLQLPNCNSHQTTHLSLFVLEEEKPTNQPDKVKKKRFSVNFFNSN

SEQ ID NO: 24715 - protein, 84 aa, Candida albicans
RCQCIPQFYLKCLSSLHQQSITHSFIQIVIHSFITDYYSFLYYRLSFIPLLPTIIHSFITNPKLSSTNNVLEKYLECSCFCFIN

SEQ ID NO: 24716 - protein, 67 aa, Candida albicans
NSIDGERSSIVTHTHSHKMTVTNLVRSKKGSGFFFMFQFATYRDFQIYRITVTSLVVLFLIFWCVVP

SEQ ID NO: 24717 - protein, 63 aa, Candida albicans
FIIMHLLKTHHSESTSISSCSLFLKYETEFSTNAIKFLHINHRINKAKFTHAPKCKSLYSILL

SEQ ID NO: 24718 - protein, 63 aa, Candida albicans
EIHVDNEKKNASSSLVRHYCYSLEQQFLVLRFCFFFSAFKHKKHTQPQDIKVKFCNILIVTPL

SEQ ID NO: 24719 - protein, 150 aa, Candida albicans
TKPKKQSIIIYNMKYFTIATVLTLASSALAAIRDVQLFAQSSNEEINNLGLISRREGAGVNYLFLASGAETLKFDDETFTIFSELQTGSTTARQLLVVSGGVVQLSVSGQPLHVEIAEDGSVKFAGSDSVAAAKNINDPYNYSKRFIWRC

SEQ ID NO: 24720 - protein, 127 aa, Candida albicans
FIFIRMNFEPIDYLLTLNLDFSNTVPSTEVSPQIDQQELDLFTQAANDDFFSLDVFGNGDIVPIKQQESVKHDIHSTFDLPKSVSRPIKKETASASAADDKRKRNTAASARFRIKKKMKEQEMERRA

SEQ ID NO: 24721 - protein, 60 aa, Candida albicans
LLPMHVLPARGEDWLIMICQLINMANQIHQLICIELVQLVDLVELGYLFHLFMIEDHMTF

SEQ ID NO: 24722 - protein, 63 aa, Candida albicans
DSRFVSNLVARLICSIDSYICLCSVYFRNTTNYLYLLGHDFYKTHNITVALIVVTYVFFLLLL

SEQ ID NO: 24723 - protein, 98 aa, Candida albicans
LRCSFDPGLVKTIVSMIPNLIQYLFFETPIKKMVLKYPDLPEDEIVAIIGFDFIGDCYILHFEHNNGKRSWATINDAQKLAPEMVREYIRQPGHKSIR

SEQ ID NO: 24724 - protein, 251 aa, Candida albicans
KYPLSNKLTTKKTLRCLDCNNLVFSPIIENIPPTVNKAAVKFNAIDYLPTISMSKILNDQSNWKTHQVMLLHFINPLKTKVHINVSIPSSLQIKHTTENTNLAITTTPIPTTTIKLTILRNEFTLGGNTPGTNVVKTIPTALLTTNTSISKSELILRKGDSMYKQPPSSIEEIEENLDDYIEKGINWCSIPIIIKFRNNKSQFKLPENFLFKLPIYVNLKSDIIPISLAKISDRFSLGYWNVIELNNINIT

SEQ ID NO: 24725 - protein, 235 aa, Candida albicans
KIICHNKTIYFTFTIPPINLYIMPIHNDPENDNELINQSIPVTTIARLFKELSFKDPQTRITLSTLELSSEYIKLFINEAIIRANEERIDEGDTLVQIDGIDNVTSTAKNNQETQYPTIDEIEDSMRIDDDDDSNNINIGTVNEDDDDELIDDDYFQDESDTQRQLRQAMDAVNDTTRNNNHNNNRNRTTTTTTNNNNNNNNNNNNNNNTDNNHADNILDSRHLAKIAGILTLDF

SEQ ID NO: 24726 - protein, 61 aa, Candida albicans
YLLYSTDLKTKIKERNRSLFRINIWSRDYVVVTNSTFLGLINLLFEHFINCNNSYCSSVWG

SEQ ID NO: 24727 - protein, 116 aa, Candida albicans
KFSNNCLRKRFAIIFFTNLTSDVTRNITIGEAKHRNINLIYTSKLQNFVDTSHTPKSETSDNKKCGECKQNLISSIFIFWPQMINRHLAKRTVLGLYCFNYLNNQTVLLHPQLVKT

SEQ ID NO: 24728 - protein, 89 aa, Candida albicans
HFINSIPEYQNLVPSNNNTAINYPPPPQPPPPPPQPPPPPQPPPLLLPPPQPPTPLLLPQPTTINATAASYQYYYLVHLYYHPYINPPH

SEQ ID NO: 24729 - protein, 61 aa, Candida albicans
YIFESSYALIYLAGILFFTDEGLFGKNDKLNNITKTSQFNSVVSLAYALKLLTIHAGCSNC

SEQ ID NO: 24730 - protein, 97 aa, Candida albicans
QDYITDKHDLEININNIHLDVTTSNLFGQTKSTKTLLHNVTASFQANKVNVIMGPSCSGKTTLLNYLSNRLSRNSKFIALGSIRLNGNPGILWDSTF

SEQ ID NO: 24731 - protein, 74 aa, Candida albicans
VKILLTKIPNDSPQLIETNPVPNIAKNICGVLGNPQAKTIKAAKKKHGITSVGNSLIKYDNPNSVTPYIPSRYS

SEQ ID NO: 24732 - protein, 75 aa, Candida albicans
IVGESKIHYFVLPKYTTNENFQVFLPFRFDFFLNAFKFKPLSTNSNLFQLILYIYITFYFNYLDQKQYITPKWIN

SEQ ID NO: 24733 - protein, 601 aa, Candida albicans
GLKEKKKIKTKQSKNIDIINSNPSTASFFSMSEQVKINPDLLIILVGSVINKCISEYKGDYKDCKALFPLNKFILDLNNLTQEYTTKFPNIDIHFPQIDIKLLSFIITKTLYHKFVTVTQDHVIIDVLPHAYENYLKNIVATSTLRYAKYLLKSAKDLYELEQKKLRKEKGGVSLQGNAPKETIPTLQQQSATPNEKQEVVVPPQVKAQPPNSTNTLKVNVAENKVDTIKESKPISNVPEPTKVQPKPQNSDNKDSTVSEKPSPNESTSLLVTKEKSEEKVVDEDQTMESSEDQKNEEQDLEESKELSNTDTDKMDIDEPQKPIDDKTSEKVEEEINQDQDQEMSDEGEEESAGVEEQPKTLESTTEPLDEEKVAENENGVEVPSDESKQDEVALEEKQTDEEAEKPIESIEENDEKNKESVIIEEDREEEILKTKESEQEQEDKDEEREIGRTEQDESDEKVEETGKTEEETNKEEDAHQPSSPEEESPSIEEIPLKHELDADIEAIPGSDSSKEATPEVKQSPKISDDQGSQESPEKSHDDVPSPPPPPFTSSSASRKRARSRSPLPVPAQQHKRFQNIAINLLNSIQEHRFSSPFFNP

SEQ ID NO: 24734 - protein, 83 aa, Candida albicans
SPLYSLIHLFITEPTSIISKSGLIFTCSDIEKNEAVDGLELIMSMFLDCFVLIFFFSFNPQPKQKKKFQQIIETWGGDIIHHQ

SEQ ID NO: 24735 - protein, 61 aa, Candida albicans
LVSISTNFNQILCIPILIFIHIVFILFYSFVFRDSSPYSLILDLVASIKHYNNMSLFVSII

SEQ ID NO: 24736 - protein, 95 aa, Candida albicans
RIIVLVKSLATAKYDISYTIECLPTSLLQGLVGNPTYSFQWDNINWIATTITVKKKTRPNFDFPHHVSCIKTWYPSKKLFHMNLRLIGYTEFYYV

SEQ ID NO: 24737 - protein, 90 aa, Candida albicans
LIENQIRRHHWEWDVKIFGVTRMLIQFGLKLISFFFFLARFSKIEQRISEGALIIDAAWPKEKNREDRKKKNNVNMSACLIIIQPHFNPI

SEQ ID NO: 24738 - protein, 85 aa, Candida albicans
HLFNKRKKCPEDGWQCLPCKTRGQECIWPHGPPNISTTTHQTNLPHSNISMCVITRAENTKDEDIPEAMDDIGHLNANVIVPSSQ

SEQ ID NO: 24739 - protein, 80 aa, Candida albicans
KREMNQMYQKKNKFQETDIRFSCEILVIIISSSDDDKISSPVFTAYGIINECALFFPHLLDCKPHIVLRDLIWNVTNPLG

SEQ ID NO: 24740 - protein, 84 aa, Candida albicans
TLTELSSFSHIKTLECISYSTTDQTIKMPTKLSNKYHDEIEQNGFTVVRNFLLPQEIEKYTKASEALVPYAFSLTAAGRTRSLM

SEQ ID NO: 24741 - protein, 288 aa, Candida albicans
LYYPSLITMSNESSLKASIRKINDNAVTISTPHTVFRILNFGARMSLINFDGNVIIYSPMKYDQEVFDKAIKVLFENQENPQYEVKYVIAANDEHNLWAHVYKEKFGSKIIDGENCKLKSNCKADHVVTSKIYNKVIKGSMWQDELNVSDPFMQSLELIGLGNHVIHDLELFDTTSKTLYVGDSIYNLGVPGTTSGNVILEQYSPELGYAKGYNPHGWFSFLTRYLQPDSIICRYLANYAAGTKTKEGKEAIQTVYNWDFDKLVMIHGNVIEKDGKDAWKKLFASSLV

SEQ ID NO: 24742 - protein, 279 aa, Candida albicans
SISLIMGYPSPLKVVTKKISPNVLTVSSPFSILNKLNVGARMVIFHYHGDIIIWSPLPYDKEILENAIAELTTEEYTLKYIFVINIEHNLCAEKYKQIYPNVKLIGPENTARCEINIPLTEDNALKIIKGNDGWGDLGISDDKSIIDNFELIYNNAHKNRELVIYEKNDKLLLLADMIMNLGIRGTTTGEHVLEQYSPELGFPKGFNPHGGWSFLSRYLQPNSVVGKFLMNRLQKTRQTPEKTKKVMELINSWDYTTIIMVHGDLITKEAKRTLSDVHL

SEQ ID NO: 24743 - protein, 74 aa, Candida albicans
HIFINRHCPTTHPGLNTAFKMETYKVVPKNRYCRHFAKIVRQEKPVEKQDSSSWFGFKKETKEVKETKPNPGGE

SEQ ID NO: 24744 - protein, 92 aa, Candida albicans
KRSQFLLLTNFFFFLVVRNYLTKLSNLAVNLEISFCASFYIETKKKNSALPKKKEKRVSKYFHLTLLSSFYFFNSLRIDLFLVMDEFNCTGL

SEQ ID NO: 24745 - protein, 70 aa, Candida albicans
RITFLSFIRTNCHCRERIVDDNDGKTTILNKLFRFEGEGFMTCLYSWISKITKFQSTICNNEKIPHNQKC

SEQ ID NO: 24746 - protein, 66 aa, Candida albicans
PRDYLIWLNNSAPPRRRRSLLIKEIDFSSICSSYCLVNSHFQRMVKKMVKKKLISHPSNVVLLYKP

SEQ ID NO: 24747 - protein, 116 aa, Candida albicans
KVCRFLFVCTKSLLLHIHYRSNKYLVIMFMRKLTVSFKYRFYSHVLFKSRECSYLQHRICSMNLKFYKPVLGFFGVVISYGIYYKYLYFLLNTVEHYGIGLVNSFNQRGPQHLVDK

SEQ ID NO: 24748 - protein, 154 aa, Candida albicans
  UNSURE (47): Identity of amino acid sequences at the above locations are unknown.
KTMVTSHTGEQLSYSVLRSNLAFSIITIHGCKILPAKLINPKIPAYXPEIQHLVSIILEELSLYIPQDNYSSSICIASLFFCGVAIINKPQQDLLCYKLSNLKNNLSQIVADNLISILKKCWDRETTERAIFGDKCYKCFDTIFDREILESVAF

SEQ ID NO: 24749 - protein, 67 aa, Candida albicans
KSVGTEKQQSGLFLVINVTNALIQYLIEKSSKVSPFELYMYAFVYCFAKVYKIYTCFSTQHTSFSSS

SEQ ID NO: 24750 - protein, 336 aa, Candida albicans
  UNSURE (331): Identity of amino acid sequences at the above locations are unknown.
ETRNMSDNSNSSGGSTIPSLCYVIPPYLLNSNYGSNLQKQLFAKNQQMGLLNVILTDSKNYYNHFKEQQQDQGEGNNKRKRKFTKDPYLNEIIKMKLIYKLSILGVLGDNPMEFLNGNDNDDYIYDMFDTFKRRLISSDDNDDDNGDSNSRDESKIGDGSDSGDVQLMLVDALRRNNKDDSNNYKLPKSVFSNGNNKIGEVEFNQLSGIPSQYKKYLSMSLKDLILLTNCHINDRYNYPPSFIDFGNDEFFNYTLPITWIPLIPNRYLSHLEKHYNLVIQDDQGFSNIKMSIDTSPNSASSSGAKNGDGSNLYQHDESHDDIPIDIFAQQXKRSSS

SEQ ID NO: 24751 - protein, 78 aa, Candida albicans
TELVFFNITSLCVCVCLTLLMNCGGVEFKCKRKSRINGNYITSDLNCYSFFTEHCHEKAFSNQKVMLILWRRDFDIVL

SEQ ID NO: 24752 - protein, 72 aa, Candida albicans
KKNSFVVCCLLFKIKKKKKIKFHASIPNTREIKKKREKKKKNYTTLSCASDIIFACSQHYPLHVPPPPPLSI

SEQ ID NO: 24753 - protein, 63 aa, Candida albicans
  UNSURE (22): Identity of amino acid sequences at the above locations are unknown.
TKRFKKRRLNGVINCKSKKTDXNSEGVSLYGLAPDLDLFIEINSLLLWIVNFVGTIVPNLINH

SEQ ID NO: 24754 - protein, 130 aa, Candida albicans
LTIWMDNMVSILENFTNSFPRNITALNSQKRGMPLQETSPNIINKSPIKQQPVSVISSKKRLAGSPVSLQRESVRLKVNKPESTPTDFDSTFGTTEAEIELNYRNWLLERRLQQANEMKDFLILEQEVSI

SEQ ID NO: 24755 - protein, 180 aa, Candida albicans
YIAMLFKSVLLSTLIAVQALAENLAHQEIVTVTKTTHISNPCLENYAKKLLPNNPTGLTTGIPIVIVYAPQQPDNQVKQSELLQPTQLSKAQQQQQIQGSSVPASIHDTPTPTDHTKITVTSTTICNQKVCTVKTFSTIISHSESPTTTTTTTKPNKMKKSLLLIQSLSLTKPSPAPMVL

SEQ ID NO: 24756 - protein, 63 aa, Candida albicans
TINNRLNCKLTIPFQIVQHYSFIACVTQIIILRDYLKQYTKLYNEIQKKKQKTFPELEDPASD

SEQ ID NO: 24757 - protein, 97 aa, Candida albicans
LLAVSSLDPVSTLSELELESASELKLELSSTELEELWLSELSDVVADTNSEDSVVDAIDEEFKNEVLDNNLELDFSSTIEDSSEEFLIVLDTRDEFV

SEQ ID NO: 24758 - protein, 320 aa, Candida albicans
PAMDFSDRAPLSLDRDRVTCLLLINTHLIKKCCNIYNTMLNNQQLMQQMTPENRAMLSNVYNNYIRRLQCNLATLNYLYEKYHSTQHLPVAAKASFPMILSAPPDMPELNQLYSKLQELYPEAVQYFKIKFEESRKQQAFPAPQQNQPPPQQHSLHQQLPPQPQPQSQPSLQQQQGLQLPSNVPSQPVQQQSFRQLSTGSESGPQIIPQRAPPPPQQQQPPPIPPQQQLQQQFQQQLQQQQLPQQPQQLQQPQQPQQSQSFDDLLLTDGFNPSSDSLGGTGPGDFNPNYNNGSFQLSTLSPQQILQQANENTPISQDFLF

SEQ ID NO: 24759 - protein, 80 aa, Candida albicans
FRIEEISNFLSVVKQQHKSIVDVLPSAKVDETDHYKRDPSPPPKYDKNGNRTNTRERRVTEALEKERHALVFTTAWQIRA

SEQ ID NO: 24760 - protein, 115 aa, Candida albicans
  UNSURE (28): Identity of amino acid sequences at the above locations are unknown.
ACPLIITDETTDDIIYHLLKSHFRAIAXNLGKKKKPLLRIYTTTLLSISFPFAIFHFVWCCVFSHIDKKKLDFQKNLFPDLYLTKVKKVCFNRLPYSIVNIYEEMGEINEIMLLD

SEQ ID NO: 24761 - protein, 156 aa, Candida albicans
MDQDNEIDRLRETELWNNNNNISNTASDPNDLTLPSSITAFDPIQQQELEQLQALLDPSSSLSHNEEQQQQQQGQQHHLKNNETSQCWIRALIFIGYCISTVFFSIHLWIQYFFVKYTYDDQTAVNMLNYVTAAQEQAIDEYLRKTERRRSRESDQ

SEQ ID NO: 24762 - protein, 64 aa, Candida albicans
RRRRRGLSRSLTDITQSTNDHLFATITNFLTINILKLLLISCHYLNKKIIIIVMSNIKKKDTLQ

SEQ ID NO: 24763 - protein, 83 aa, Candida albicans
NSCCCCCCTARKTTQLGNEFQQMKVKFVIRFTETHFYCNYYYLIDQRITHFSTNNLNRKVIYLLNTSLIKIRQSIGSLGIVAS

SEQ ID NO: 24764 - protein, 78 aa, Candida albicans
VLPVITVKEGKERKERKKEKKERKIQRSVIFFFSMYVCRGGGKKCVCVLSGIEDNNTKKILSPNLFLVCAKFVSQRVF

SEQ ID NO: 24765 - protein, 86 aa, Candida albicans
  UNSURE (38): Identity of amino acid sequences at the above locations are unknown.
FKLLEMNYLFNLQVYWELVWIKVFVFVANSLLQYGEDXVSEFSSLSEDAIPPLNIQRERMLSIDTLPTPFSSITKRRTTKGRRRKV

SEQ ID NO: 24766 - protein, 584 aa, Candida albicans
HEGGYTNMDSHNNIDQSVSELLLDPASVQQLYNSQLRGPEFDQQRQIRNQVLPFNKMTDTIDNDNIPLSSDYDKLYQQFSIPSQQQYENNSDNVYKTNNDLAALASPLNMDLDLAPSDQQQQPQQSQQQFLNDFSNLQPHLNNSQEQVQLNGLTSNILSNPQITVNMPGAYHQNYNCDQMEIDDSPPFTIELDLYFEQQTDNNSIVTSNRVHNQPDVESMFNNQLSVPSLQRTELLPQQHETNVTTGRPQESAFGSFDNNSRVSSFANVNNAGTNLFVNGKDLYFDDESHHRTGRLRNGSIDSYYAANVINHQLHLQQQTQAQAQAHQQQQQQLQQQHSPQDLASHTSLPSKSIYNELSPLTTTTSRASSIQSGQPSFFSAQQYFSRNSMDQVPSSLHRPSFDLYNHRPSIDSQHSQQLQQRNARYTSFTSSISNILPFMSEKNTNHNNRSPPTPPTSISSPQNLLSSNQSRHLIRSIFKTNPTPIVSDAGNSNGNIVNGGSGTIDAENLPDAPYASGTINDSEFLILSSPTKEEPEDELMQPKKVKKPKRSLFTRFKTPVKQEQPDLEMAVSAPVDVLNRPTG

SEQ ID NO: 24767 - protein, 70 aa, Candida albicans
LSRNNNQRALRRNHTYTRINPLLFICFIQSNLNNRKYLEYCLPIVSTIHFFYYFNNVNNQYPKHQFTYIP

SEQ ID NO: 24768 - protein, 94 aa, Candida albicans
RWKRARMSISCHDVTSCQVQLWSGPLMLMKLMYKTKLNGNNHEPLAPPSTEWTESLAGEVQKKVHRVANNLVDLVYILFISVCHDNHTNNKLRE

SEQ ID NO: 24769 - protein, 67 aa, Candida albicans
  UNSURE (3): Identity of amino acid sequences at the above locations are unknown.
RSXSKVDKIIHPNYLVNIINHISSKGDTETVFKAYRIDDYSLDKVNKNTNLELGYSTNSKFINGMQI

SEQ ID NO: 24770 - protein, 60 aa, Candida albicans
KCYLKTGKKENAIRLKDNTKWAYICQLKLKKSKVDLSITVGSFVVVVVVVEASNLPMVDV

SEQ ID NO: 24771 - protein, 81 aa, Candida albicans
QQLFSIYLHKKIKMANSDDDDAFLYSDEEQEVEKQGPKVKRVKFADEESNKEEDKTNEKEQQQQKQAASNLNDRRRRFISW

SEQ ID NO: 24772 - protein, 61 aa, Candida albicans
  UNSURE (7): Identity of amino acid sequences at the above locations are unknown.
ASRDFPXPVVAKHGMNYKQKRKIVLLCYNLLMTVLNNLSIVSCPVTPEFYIYFFLGSFSFR

SEQ ID NO: 24773 - protein, 62 aa, Candida albicans
FTPEKIIILLLLLLFFICPPNCILSSEKKNLSSNLQLKFDPKSKKIVYKQEQSSLFCRVGIF

SEQ ID NO: 24774 - protein, 226 aa, Candida albicans
RMNSIVILGVKKLELHVAEDQEERLTFSADLEDLIIYSNRSIQMTLPPNLRKLDISAFNSLVNFISQQMVNLENLLLTLPNIQTFNATGITAPNLKTLFLQCDLMNNLDDLRQFQRLNKLVLKGFYYPIGLFNEGSFPELEKFRCWECFFPDSEDFDNSLLTFPPNLKELEINVIRFQNVNISSSVFPSTLTRLTLANFSFNYDYLGDNLQYIDVRTSKLVFKSDL

SEQ ID NO: 24775 - protein, 164 aa, Candida albicans
KQDTPTTIIATPEIFNTPFFDSFLFYLFSFKLYYKNFFFISIIMLDELSYKVLTNLETSYERKQPLGSKLIDRYTLTIDQSTVAQQSYFEQIIPAINRILMNSEAHVIDPDDVLIRLLPEILSHLSFEQILMYYPNDIILHFLFEEKLENVSVICLEIMLLNLQ

SEQ ID NO: 24776 - protein, 75 aa, Candida albicans
FNAEHNYNSVISGVILSLHYINDLNSSFASKKIFFSFHFSSFFFPSIYQYIFINYLNQLFVHIPRLLTALFNSYC

SEQ ID NO: 24777 - protein, 107 aa, Candida albicans
IMMSQATPSATPVRNADGQKKGKKLPLIVDVAIGNNGKQLYQVHESSKMVRKEMPRSTNFALNDDISDEGFFISQINEQRTPIRKTLGTLSPSSLNQKRIRHDVYYQ

SEQ ID NO: 24778 - protein, 63 aa, Candida albicans
VHGYIPVISSNLIFIYFQFNQFTSISLYLLLIPHTNSHDSHSNLAAACFNLYPLVFYYFCFFH

SEQ ID NO: 24779 - protein, 72 aa, Candida albicans
IKIKLEEITGIYPCTYILFSRIKIKGSQGPCLIHILYLMLFVFEVHFFFYSLFIFFSLLHLTYSASWFLSPL

SEQ ID NO: 24780 - protein, 62 aa, Candida albicans
VSFSYFDSYRRNILVIKKRNWWLHNSLNQNTTKNRSNLTKILHKYYLRDEFGHPNLMEGGFN

SEQ ID NO: 24781 - protein, 78 aa, Candida albicans
LTNQLLHLLHHHFSPFFVPIPSKKKKDIAQNHEIPPIFKTNLEFHPLIKITKEKEELEEKIFCFSFFFNFLFASVLLL

SEQ ID NO: 24782 - protein, 67 aa, Candida albicans
DQEVDIKEAGWTGQDGGNKKRAIKKGTREKKNKEEEEQREGRNGSLSNYIKMINKSKQRKKERGFVI

SEQ ID NO: 24783 - protein, 90 aa, Candida albicans
RIQDVDQFMPRIISKIVVSPPQTKSGNFKLYIITNCMNNNNNNNDNRDSLFSFFSLSVCLTKSRSNCPQYMSIRLLLSFETTPQFEESQY

SEQ ID NO: 24784 - protein, 61 aa, Candida albicans
WSTSFLLLYISYYFYLKPNKNLYNQSRVFSLIQCIICFSILWLTNENENEKEKEKKKVNII

SEQ ID NO: 24785 - protein, 61 aa, Candida albicans
GQFDLLFVKQTEREKKENKESLLSLLLLLLFIQLVIIYNLKLPDLVWGGLTTIFDIILGMN

SEQ ID NO: 24786 - protein, 63 aa, Candida albicans
IKRTSHDWFLFFLLCITKCLNLIGQFLNAATSYFGGLTPGKKEHRGLQQHQEEIIFTTRLEGP

SEQ ID NO: 24787 - protein, 64 aa, Candida albicans
SRRVKTNGPEKKKKTKIFRDFGKKKFCQKNTSEKETSVMDGGRKDLKKKKNVHESHLCKGGLNK

SEQ ID NO: 24788 - protein, 71 aa, Candida albicans
HSPTRKRLYSTIFFLYAKCYTFLFARVSVLAFFQGYMSFTFKQPSMEHKMPGHPQLLKDCLSISTELSLNR

SEQ ID NO: 24789 - protein, 302 aa, Candida albicans
EVHHKPTTIMKLEMSSYLHKVPNTGITNLSNLKLIFFIMFCATLLFIITSSRYLTGSESLGQIPSEIPKSSEQLNEELSQQINSKLHKLASFDKFNSFPLLNKHMKDDIYGSMTLETFTDPLPYLENYNEEEYSQQNYPICSEKLMFPSKIKLTKQQYLLADLQQFLGVLNNMRPYHDMVEKAKAYFISDLREEKKWFRFAGSSIWLPQFQCHYMVSRYLYSPNGVANHAFASFLYIQLFDSDWKELPSHTTLDIPFERTEANCIFEIFKPKQKYANFRNSTYPQILRIPFDYELPIETKKY

SEQ ID NO: 24790 - protein, 357 aa, Candida albicans
YGPEDPRILLRSNPLGFDEPLIVFNMKGLKLTKRVMYSYLPFSNTLKLLKKRREPFANIEKNWTPFKSVAQPSKTQTTIHFIYSMIPLEVLACDIDSGLCDILQKPAKHDFNYVGGLRGGTQLVSLPLNETIPSEIRAKLPIPKNRQVYIGWARTHLNNCGCGDSMYRPNFITLVEDYDDVTDKYYYKIGDISGYFDFAAKIEPWSKQVLDEEGNLYEKAEQCQGRNVLIPNSIAYWDVGSIKLAGTEYQKHDFKDMFSSGKVSDFNANEIVFNDYMGVTLSSADRDVSIVHVKGLLNYILQLPSLVDDSLVINKEWTFQKKGHDLNVRCAMIASKEYCKSYAIKQGVKIDEKSEET

SEQ ID NO: 24791 - protein, 71 aa, Candida albicans
IMPTKTALLISFVFSSFFYKLMPSHFYFLQIRIQSLHLSILLDIQRVTMYAMLLISRVKWHKIFCRDELAN

SEQ ID NO: 24792 - protein, 60 aa, Candida albicans
INGYGGLYQSLQMYKEEKLGHALGLVHFSLLSLQSKQAVITESTKSTKNIIRNVRMKFNK

SEQ ID NO: 24793 - protein, 79 aa, Candida albicans
ILNDLNYLFDQLIKVNLKFTKENNNLKFDTIVKWLDIYVDSKWPTGCPIPISEIKPYDPHPNQEVTEVKLDYTGRGAYY

SEQ ID NO: 24794 - protein, 67 aa, Candida albicans
IFFMVIQQIHNKPPSHLVINAPLNYASYMKIESSNIQRNMKPNKEKNNKHMSIQLNICFLLLLLLSL

SEQ ID NO: 24795 - protein, 77 aa, Candida albicans
TISLVYETSNYNNTTKKKYIIQHLINYIETKQNKTKYTIKYKSRRTKKENTIIIIKKHQINYEQDEPKLHHHLQSNQ

SEQ ID NO: 24796 - protein, 60 aa, Candida albicans
VETLIQASYNYVIHYDDNNNNRNEWNRNKKRITKIKITQKKIMRNDLQDYTLFCTQIIKS

SEQ ID NO: 24797 - protein, 106 aa, Candida albicans
GATTTTPTAIARGNYQFSSSTNCSIFHYHHLMLNMPCQLPQQTIGTFVPLISQTFGVSYTHNTQHPSGNMDLMMLSSMNTGYGNITNNQDYQFGNIGYTEGFTSEF

SEQ ID NO: 24798 - protein, 167 aa, Candida albicans
  UNSURE (138): Identity of amino acid sequences at the above locations are unknown.
LHPNMNKLPKGWNFTIVDDNADLTNSENIQGKRPRRSRTSVQRSDGASPIIRDNIVLIRTDDNEEFKVGDTIEITQGKGPEDPTTEYGLITEIKLGNSEFIEVIVDWFIRSSEIVGMPNEFFADNELLLTPFRSEVKXIDFIRPINVLSESQFADVVINESISHPTF

SEQ ID NO: 24799 - protein, 65 aa, Candida albicans
NSILWEVYSYLDVTKVVLRLYRSEKTGTVLFVNLNQTKLSALFFFGSVFGILPLLIILRTELNYL

SEQ ID NO: 24800 - protein, 97 aa, Candida albicans
  UNSURE (7): Identity of amino acid sequences at the above locations are unknown.
THHYYVXCDLSIPRKVENIGLSLKIKYFQGTVNDDFDDGVTYGQEPEPERDRDRANYAETDYSNSSEDESKEPPFKKHAFDEELGPTQLNNKPKSIF

SEQ ID NO: 24801 - protein, 61 aa, Candida albicans
KVFSATGYEKSKKHITSDFVLHIDIDIYILTQPLINFVEIFVHSFIFSFIHSFFNTDNLKP

SEQ ID NO: 24802 - protein, 63 aa, Candida albicans
INAGKSFNFKLSRICIQCYLFPPRHEGLIPYLHHTPGLVIPPYMLGSGLGITATYNLKCLVPP

SEQ ID NO: 24803 - protein, 75 aa, Candida albicans
DRWGCLLMIARTEEKKYCAFRYYYFFLTTRTTKQSRLIISLYNFNIENYLIKTDQYSTIPIYFFFQIIYRNNHRF

SEQ ID NO: 24804 - protein, 129 aa, Candida albicans
FCYIYSKKEISQKPNYTKTPSFTLMPPKRNQKSKLSLSKTFEQVDEEIEDEIFETYSELLGDEVENQDVTLSQLPQILSDLRIPKCFTKDIEKCIDYYYDFIKDKDVHLDPLNTRQQNTFAMIFSTAAG

SEQ ID NO: 24805 - protein, 65 aa, Candida albicans
PFCHTQLLKLWGEKKNECEKSTLASKEVNPNFVIIIIPTLLDNRVTKTQLPQQLNLQYGILIVIK

SEQ ID NO: 24806 - protein, 113 aa, Candida albicans
NNRNNADLAFHTENNGNSIKNGKSMNRTGSLLRNNTINANATAKARKQAAKEIKEAKSDPIASKTSKEDIILRILIARGKRNYVCQRLNQRAKLAYSMATERMARAAAERRFN

SEQ ID NO: 24807 - protein, 80 aa, Candida albicans
AFCVLRKMSLNTKPMTIFLANVVSQKNKNLSVAFQNGPIRRIQILVISNINNLMGILDILGIMRKTGCYTWCKDLVLRWL

SEQ ID NO: 24808 - protein, 67 aa, Candida albicans
GFFEFKTRSPALNKENCLEGVQLCNKIEETQPIDSCIVFGRRYDSWPLHIVQIFNVKYFLGVGTPDG

SEQ ID NO: 24809 - protein, 659 aa, Candida albicans
LNDNIKRYNTVSFTTLAFFIIIMSNTEYISDSEDDSLRGELLVDKNKFTNILSTLSPSKQELTRQRLETLTNISYVNIENSTCSPRLGHNQNSETRNTINNLIEDSDDDSDSNPIDLIKNLPRRSANEIEQREHSTSQHQSQDNAITQNIVGNTVVPEDQENENHLQSYLNTTNSYVTWSGRSLRKRNFASTHPYLADQAHYLGLSDIDYLNEIYEENDHNLEKVVKYLNYNYERLKKRYPKDEKFRSKNFYTIISRQSHLASEKELQEEQRNGDSGSLPNIDEEFEDEDEEGNKEFTIDPLDDLNSQTYETDESSHEPDDFLQPVKHHRLVIPDDDDEDDNFDTNSNFYSRNVANEESGSGSDSDSSKSDVYVRVGGRFRKERNALKGVLPESAKRLSIYQPKSKGPSSRHLQKPHPVLEHRKGIALRKRTKRKISERDDFTGFVDDTITYDTNNELYHELYDQPIVIEEPTPALNYPSFESVTNFSESSASEDEGEQMNYESDLDIFDVGPPQADITGVDEETGKLDENGDLDEPLDYEVREGDYINHMLATAPKRKTTAPKRQSASATTMGTSGNRTYKSQNRSIDGMLSRPKKAHSYNTKRDVRRSDSSTVSVINRSTPNSRRQRKPRTARAASDESYSRLPVKRITSLRDLNTR

SEQ ID NO: 24810 - protein, 85 aa, Candida albicans
TLQLYTFTLMIYKVLIISTRIVRCFLLYGFCFCKYHLNSPNKDYLKYIAQLYQSKKLNNRLNNSQVIQNSQEVRKTCMTYFYAHL

SEQ ID NO: 24811 - protein, 97 aa, Candida albicans
LRLDSFKKFSGECLITNSWKKNEIPSEVKSNQIRRKTVNNYALSHPNQFIVLELFIAKRATFGDINNKDTNTMGTRIQLKLLKMIVFNLAPGNTSLC

SEQ ID NO: 24812 - protein, 62 aa, Candida albicans
CKNSHRRGVKIQPRLVSWFDSDLNLSMIMQNGTLSTLVDLFHLGYKQYRYISDITINRKYTK

SEQ ID NO: 24813 - protein, 67 aa, Candida albicans
YFSRILLDKEMKKRANHCFFGVMLVMNTATLYIYVNDLQGANNIYTNSEVFSPIRFLFLQISSQLSK

SEQ ID NO: 24814 - protein, 93 aa, Candida albicans
FDVYLKFSLSIVIWGYIVKSVSLDVSVTFGEVGSKPSFTRLSLSLLWYSFAEFLLNYAHDLCSVNKRYFLGCSSNYYNQGIINEHKSRSYMFS

SEQ ID NO: 24815 - protein, 101 aa, Candida albicans
MSTVALLNKVCDNLIMGELKGTVSLSIIRSLIKSITEYQLFGHLFINYYPIYVLSILSFNILPIRPNIIQIYIPVNSKLFGETSIFDLFQIVFSFSSSSSN

SEQ ID NO: 24816 - protein, 82 aa, Candida albicans
RRTLQQSDIITVRCGAAWAEGTQQDTETDTGTTRALSTRIKLSQGKQNKTKKGKKKGERETIVTMYTTNKNFKKKKKKKSPN

SEQ ID NO: 24817 - protein, 70 aa, Candida albicans
LIFGGRGLRNHLTKTGKTPFFYQFNNLLNFRTPSLFKQKLSYSSRITNLIRRNFVQTLQDKVDFLKSKQK

SEQ ID NO: 24818 - protein, 75 aa, Candida albicans
PMIFMDFLLSMFSWLNLASGGFEGDLMEIKWDKVVGGSNLPSWLYASDYRPFFQMGNSNSRVVNCNNIITLLLFA

SEQ ID NO: 24819 - protein, 60 aa, Candida albicans
KKNYAKNYLTLKPFRKFNANSDGIFETMPSSIYVQGFSSCELKRIPQSQVLDSSNFATCI

SEQ ID NO: 24820 - protein, 72 aa, Candida albicans
EILFDNSTEKRNKNNNYYWSHVNRSCFFFFLLWRSHKRTNKNEEEPVRMIKKSLEITFLVIQSAQRISHSVM

SEQ ID NO: 24821 - protein, 91 aa, Candida albicans
NQPKKNTHLTAYTTQTYSKQAVAPPFRLSLCLEPISVLLSPDLHCPLLSKTRLKYYFNTAHCYQDLHCSLMYRCPTAVLITRDTAKIGVPL

SEQ ID NO: 24822 - protein, 65 aa, Candida albicans
KGVLQLVLNRFALYRQLNVCFFWVDFTKKSAEKNSLNEVIVKIVIYKKLKTQWKSFRMARRRCLN

SEQ ID NO: 24823 - protein, 229 aa, Candida albicans
DAALPSSWWRACFQNGLENRQELLSDLDIDPTIQVPTTNTTSTTTFPRQVSQPQPQHIPVSSLKFIPPTSNQGMQNYRKYPHQQIPEVQRSSTNTLIVKPIDKLESLENDSHKKPSLLSNPAVTSQLTSIISSLTSRINSGELSDANILQVIRQMTDVLASGGSLALFLKKPTSIQDVIVTYRDGVRQKMLKSLYLTKNFLDQKLPITENEVKQKAIKLISSPRRGRSE

SEQ ID NO: 24824 - protein, 67 aa, Candida albicans
CNGGGDIVNSWKPVTKKPLDPKLLTEEYILEQRRLRELRKEKIRQQKEALGLIPPPEKEKFLKRPML

SEQ ID NO: 24825 - protein, 116 aa, Candida albicans
YFKDLYKNSNKGIRGRGKAHKEDNQGNSNGKQSGTMGQICWLQVYNHNHNHHYHHHRNHHNLLMVNQEDNFPVRKKMQGLYIYVLCYYVKFLKLFDDFQAIFLLLLPLLMLMVFFY

SEQ ID NO: 24826 - protein, 73 aa, Candida albicans
FSSYFFIIITTINVDGFFLLVFAHILNEFLFFYLTSFQVYYYFVLFYNCIISVYLVYASYQKKFYIYIYYWRN

SEQ ID NO: 24827 - protein, 81 aa, Candida albicans
LLILIIITITMFTRTYSQSTKTAFQKAAIKKSIPRPTTPGKIIVNKWQPSNGNSFRSFAEYRIKVTNQSPLAIAAKNQLAK

SEQ ID NO: 24828 - protein, 70 aa, Candida albicans
SISRQPICVCEQMIFSRPLGTSKTERHNNCKAKLKFSTYIMAGETTELAIISRTTHNNIMVIDFKLQRLA

SEQ ID NO: 24829 - protein, 71 aa, Candida albicans
SFSPHVPFFLQSLFFIHPFVLLQLAYANPEQRTRKEKKGKDKDKDKDLLLVLTIIITTTVAYGYIIILRHT

SEQ ID NO: 24830 - protein, 295 aa, Candida albicans
SHRLSDVGNIIIKYIQTSIKNTISFPIITSKSIFIIIPLEHMVQNYNFNNNGNTGKTSIVTPAYSLNYMDGGFDLHLLNAILLGTNHTFKQLENIIQNHQLQKFQGYLVPNQTYKINLPDLTGFEYKSSLVYQNWNLIEIIEIPTMVVPEKIHSISHLFDCIWNLMNNIDFTKEEEEKEEEKEEEEGEEENILVLPGIGTGYGNLNEYESTKIMLFAIFLYNLSLRGKTTPTTRLDQLKKSLLILFFFNKDYRKLENLNDIEELETNVISEYGKNLNLVNETVMELEEVFKCIRW

SEQ ID NO: 24831 - protein, 229 aa, Candida albicans
YLNNYRGIGGGGYRGSRGRVSRGNNYYGNSYRGGSSRGGGGYYKSYNNNYYGGRGGGHRSYSNYHDQGNDTAGSSTTSSQNGEYESQDNTQETEHSYSSRPHISGFHRGSYRGGFRGSYRGRGGGSFNNGLAATASPTTTRHYKDIINENKLKNFNNPWINIMRIEDEPTQNKLEKSYNDMTELDSSILELQKSKLKLEMSMSLIEKQIDKEGLHVELTNEKLEEFAYL

SEQ ID NO: 24832 - protein, 144 aa, Candida albicans
LYHQGNCLYRHEDWEDIPSLVEPGHSVFVIVGEHECFRDDVLEWCHFALKSPLTSQRDDSRGVFNPKIHEYIRNGNDFAYVEVVVEPWGVHDSVLYFENTIISKVKKNPKLKVNLLNSHEYFGFIKLVNFLNNVLPGSSQTKFV

SEQ ID NO: 24833 - protein, 81 aa, Candida albicans
YLVYVMDDYNNGFAAVTILVIDDDDDDDDVVVDYVYMMVVEEVEGKNHQLIGFGFGFGFGFGVDSDLYEFHLFYYNFHDLM

SEQ ID NO: 24834 - protein, 64 aa, Candida albicans
REREGGGGRRSNSSSSSSSSSSSSRHFCDFVKFAQPLNIMRIHWGGEINLILYNNNIDIVYLCK

SEQ ID NO: 24835 - protein, 310 aa, Candida albicans
YRHNMNFDRFNPLSNYLYSSGNKNSSSPATKTAKQGSELTVPTESTHHNVVDDHDDLGGEMSDWGIEESTQTTNIKSINNLNSNNNNNNITHGLLSSPSITSNSTTTSNHGNYNKINGIHINQNQHQNQNQNQNQNQLIDDFFPLPPPQPSYIHNQPQHHHHHHHHQSQVSSLQQNHYYNHPLRKLSTTLLLQPISTPIGPESESEPDFKYYYDTLIDNQISFNTENFSKFIKRYLSLENKLNEFWEKFKYNLILSNLLEDSMVLSKNETNLNNLEQNNNNTSPDKGLQRFNGNSFIYSINSSHRLTGAF

SEQ ID NO: 24836 - protein, 80 aa, Candida albicans
SISKSPLLSLSLIKLNIVELDLDFEPVAEPVAEPIDEFGESIKLKLSIANVDDDIPEVVFVFVFGFGFIFIESPITEITA

SEQ ID NO: 24837 - protein, 89 aa, Candida albicans
EMNTTVKIVKKKMRLQNRNLQSRTVNKKKGDARMSIIYSCKNTLSLPKKCYMKKPYTRNIPLLIVGAKYAAFQLIFGLDIPFFLVVGFI

SEQ ID NO: 24838 - protein, 97 aa, Candida albicans
ENPNLLLAHLKSNNIMAPKRKSVKGGVEPKNKKVKTAIHQKEPNTLLSLEELTNLSKEIDESLKFNNLVPLLEQFKLIKTKLIESIHPDVESTVRKL

SEQ ID NO: 24839 - protein, 60 aa, Candida albicans
GQRVKLCIEVNFEFGNGNKFVHWFIINDHAGPILSEYESTIEDFYSTTNSTFIYTRLSGS

SEQ ID NO: 24840 - protein, 97 aa, Candida albicans
KDDSNNYLLIMVLPPLFLALMCTLLKNKKRCSEYILSMFSVHFYHLYTLTLEFTEIRICNHTNLNVRVGHTRNQPKLKKKQRIPQKPIISNISKVNK

SEQ ID NO: 24841 - protein, 194 aa, Candida albicans
KETHISNQFESNFPSPSINQLTNKQINMKFATITSIAIVALAQSATALRTVTLKTFGYPPPQYPEVTGKSVSAWHEGAGINYLLIAEPATKFTYDEESKHLYFEGGQGPNGPLKWYFTIGDGEPGILQANPTDHPTEITIDNLGFITFEGSYNVKGVKNIDDPYNYSKDHYVLAKYDKEAPSDAVPVFFQAIDA

SEQ ID NO: 24842 - protein, 65 aa, Candida albicans
FLILKLLTLIAISNVFLNGESMEKSAYLKIVNINKLLVSDSVLEDIIFKNSVKNCHCSNIRIPRL

SEQ ID NO: 24843 - protein, 107 aa, Candida albicans
SVCRYSTTSTVVEGSAYSSVPTIHIFQIDEPKYVPLVPHFLGFWSGDKQTLYHILSNIDDAKKIQAIFPVSLPKLSKPNRQPRQICVHVTLQVVQLNSSKIYQRKFG

SEQ ID NO: 24844 - protein, 98 aa, Candida albicans
TKRSNIFFINYYKIFYYFTLRLAAWKDNNQVIYLPSYPVSIRIITLSTQSIKYLIQMYYYQNATKSFKLEEKSSEIEYTTMKFCVMIDYAPVGNSNSS

SEQ ID NO: 24845 - protein, 68 aa, Candida albicans
  UNSURE (54): Identity of amino acid sequences at the above locations are unknown.
FFNNKLNTFTKKKASKVSHRERSFKEDYDYDLIKSWRGLTITVKIDTLSFNHLXALKLNRLDIDTQKY

SEQ ID NO: 24846 - protein, 122 aa, Candida albicans
FLKLYYLNSCTMRNTLIKRSIITPKRFHTIKLPHQINQDPVKPRLSQFSHALYNTLMISLSTFFLFNIVYNNLQYQEIEQELKLKSTTLENQIQTIVDEKDKQLKQEQESSNKRWIHKLKFW

SEQ ID NO: 24847 - protein, 71 aa, Candida albicans
RASLIDLIVIAERRCCNGMYESGRCPRINLDYKEIGFIFFILLIFLYDRCLLYSIFYSLFFCSCKLSFFFE

SEQ ID NO: 24848 - protein, 65 aa, Candida albicans
GEGASIKTGLQMQEAYCWSRQIRLSERGYTKIGRLRNLFGYVSGMERNCCFDSSFQSKILTLRQC

SEQ ID NO: 24849 - protein, 69 aa, Candida albicans
LFFEPDNQLSRIKRKQPKKISPINLILLLLSNNQLNSESSIIVFKSRFRTTITNHRLTTNETQTATLFV

SEQ ID NO: 24850 - protein, 63 aa, Candida albicans
IDHKRNTDGNTFCLAATKRNITFYTTPQVPRLSHNSDNTTTGTPSFNTYHTFKQFGLFFFSNF

SEQ ID NO: 24851 - protein, 98 aa, Candida albicans
IFQTVWKTSRMPKSQIHATKEYFLVLDHDGLPSFYEETLWSQSIHTLFVSKIASTGWYHGDLVDGCDDDDDGDGYEDNDVCYCFFARNEASSPHYNDS

SEQ ID NO: 24852 - protein, 80 aa, Candida albicans
SKISLVIYLVPIFSLFSIHTCFLTTTTKRHVLMIFKVPFDETEKVVLGLDYWYKRTENKKKNNDKITFNDFEKFWKRRTG

SEQ ID NO: 24853 - protein, 110 aa, Candida albicans
ETTLITISKFNLISFYYGYLSFTTIIFFFHFGFSSSCISNLKIQFCVKKQINQLKKILCITFKSVLILLQLINNTIITSTIRTATIRKNKIIIYKFNHLNLNFFSLSYKK

SEQ ID NO: 24854 - protein, 98 aa, Candida albicans
LYRFFLTDDKLPILERVLILNHQNLGSLPIFLSPVSHLNACKSYESSQALSQKVTKTYECLNQSASRCLTSIGLAETAVVYTRKLLNLFLIHHDESIV

SEQ ID NO: 24855 - protein, 65 aa, Candida albicans
KKKRGLCMYVSYVCEYVFANFVGPVPVAKVTQINQQKFNFKNFVNKKNYTQTVNYTKSKLHKHKQ

SEQ ID NO: 24856 - protein, 301 aa, Candida albicans
NDGLMADYGRPRKSTMEISWSINNGIKRLNGNQEEEESGGQALVKQSFSVVTKDHQRFHLISYYENVPGSFRPKLASNQTTTTVNIPSHDSKFNQLDLSNAIYPDSLLNSIYKRKHQQQQNKQHPQQQTEQLRQQSYSPAILPNSNNNPVSLESNPGAGISSNLYSLMNQTSTHYTPPSSSLSSSSLSSNSSNSSNSSNSSSGSINSQLTTQSSSPLSIPSLHIKSAGYFTSSGPNHNTFTLQKAGPQNRQQRANHPLTLQPLSKISQLSQTPTSGNNNNTGITNDYDSRTVSALNKTWLK

SEQ ID NO: 24857 - protein, 92 aa, Candida albicans
REIERDFQLSSSNNSHYLHTRALVFIFVLFSAMDLHLRTRNLFINHTTTTAPTTSPSFHEFVSVFYIPPLVFSEMRYSLYLCQLFIWYKSVE

SEQ ID NO: 24858 - protein, 65 aa, Candida albicans
ETWALLLLPRALDITEIHTTSFTMLTLKKKRQNILKRGVICDTILYTLLMPAFSIYQENYIDSSD

SEQ ID NO: 24859 - protein, 62 aa, Candida albicans
SLQSIIILNGKTTSASETYTIYDLRELFFLSFSLYFVVATNNTTTKMQDVKILLCAHNVNLV

SEQ ID NO: 24860 - protein, 124 aa, Candida albicans
YLSVKILHIYIFYFNNMQDLPPIGGYEPIQWKRNIPSRGFSGTVYFWGILGLMSFGFYKYYKAADEQREFTRERNWARFHLEPLLIAEEDRNVARRYFAELKRRELVKESMSPENREKFERRHI

SEQ ID NO: 24861 - protein, 81 aa, Candida albicans
PCGGLNLKYSFAAHVTGASTNPTDNITDTKYVNGLHLYMNTQKPGNCSFVTNTPQKAKHIVKSKTDKLAALSSISKNEIHN

SEQ ID NO: 24862 - protein, 74 aa, Candida albicans
VKLKWVLNMMSNFLSVMWERKKKKTENKKKFLKKKKCLSNDATHATFILKSVRVFLAIHFHSLLEFVLMFYFIK

SEQ ID NO: 24863 - protein, 61 aa, Candida albicans
TNSKLTYTYNNHNSIHIQFSTIFLSVIAYLFPLLIGGETNKRKKNLRANFLVFFFCNTTSP

SEQ ID NO: 24864 - protein, 189 aa, Candida albicans
LYKLPMIELVSNSNHDWLSCYIIKLIITSQEELDLEINQFLTTTIVNSQLTLLIILHHEEEEGDNDSITDLQLLNYLQFEIYKQIGNDIIVSIMTITQDSNLSVMLSSQLKQIDDIVKDILKLDLSIALDVVNEEKLIFLMLNIPNLLPYLEEQQGYDEISIEELFENFVKHHNSIKKIMLSNELKEYT

SEQ ID NO: 24865 - protein, 86 aa, Candida albicans
NWKLKLYKQNKHLTSNISIKLQPNNAIGASNTLVKPDLRQKKNNIPKQTLFQLLLLKVFLCRLISLFPSSMYFFYYFGCMVSNFSS

SEQ ID NO: 24866 - protein, 273 aa, Candida albicans
VENIEVPRIPPLHIQHQLASKQNQDQNQSQNRYEQSSMTSIHTNDNSSSVNNSPNTMMIKQEHSTFQPQHSNEGSSAYHPVDQQNHQQQQQPQQQQQPQQPMTRSICTRCKKGFDQPIIYPKSSNSTNGNNSNGQNSSSIPPPEPRTFKLCDHCRKLQRQRSRRWQKKTKDREGVCRRCGSEIPLAERRFVLCPSCRENLRVRKASRAAQGRCVHCSGPLDASILSKDNEGNNNGDEQNNKSNEDQNNELRRRKPRKACTRCQSQSLSKMSRK

SEQ ID NO: 24867 - protein, 93 aa, Candida albicans
FPFGKYQTNNKISIKNNKPKQKKTKENKTFVASISQLQLGQVVDKIEGDRDNLLSNIYTSTNIQHCLLSFLFRLVYVYPSRQFHNVSTPIFNV

SEQ ID NO: 24868 - protein, 250 aa, Candida albicans
EGGSQEKPARGASHKVCQRCRENDKIRRANLEKMGNCNRCAKALDPNEYGRNKVCFNCRTKKKRSPPENVTNTDEVRTSPIQNQYGMNMSHQYIQPPPPPPPPLMTGHHQFQPQPHMMGHEQMNTFTTMSNSGVAGIQQPNNGMVVGDQQQQQQQHNGSMQLQPTYYQSYVQMPPPLQLQQQQQQQQQHYSLDGIPQQPHSAPTSSFPPPPPPPLQLNQHQGLQQYSHAQQQQQQQHQQQQPYHQEYPNN

SEQ ID NO: 24869 - protein, 171 aa, Candida albicans
SKKKKYQHKLFAPYLRPLTDTTTTETRFMLSTCLIRNCVFIRPRLSVICFKAIRYQSKKLDFLDYTKINDPKLREIIEGSNFGTEAILKKQREDQDKKKKMEQERKRLEQEREVDRRREEKPAKEESESNKTDNDNEANQHTDDKLAKVNEKLDSSSSVFTAGIEGTRLII

SEQ ID NO: 24870 - protein, 86 aa, Candida albicans
FLLGVNAEPPNGIFWPIGPLLGERKKKRRYEFICRMKQKKKISTQIICPIFAASDRYNNHGNSLYALDLFNKELCFYKTKIICNLL

SEQ ID NO: 24871 - protein, 97 aa, Candida albicans
RTTKDDHVKHLNPQRRNKYPTGYRSRRKNEGNDDDQEDLFADKLKGERQSRSNNRNIVVGGDDDEEDLFADKLKQSKRDRSRSPMRIDSEDVSYRQR

SEQ ID NO: 24872 - protein, 98 aa, Candida albicans
CYKIVIYIENTLKKINHPSNRRIGNVNLVSIENQQRHGESFTYKIMRENYKLLRYVLFIMSCSLCLVHYVKKSIVTYLYINLWSEILTFFLFIVKNED

SEQ ID NO: 24873 - protein, 67 aa, Candida albicans
ILLAISHANLLLIICSPLPEHIQQISQSSSFFRAIAAPITPAHPILPGSLKKFPPDDVTIVVSLSDI

SEQ ID NO: 24874 - protein, 202 aa, Candida albicans
IYPLLKNWFPHIVDDDLVSENSRKIYDMYKDKIFQGDYSTHCAIPHEISDTIGITHISDNETTIVTSSGGNFFRLPGRIGCAGVIGAAIARKKLDDCEICCMCSGNGEQIIKSKLAWEIANNIYNVAGDEYGKYLERKVYELNPKFYVGFIIILNYQSRVQLLYGHTTPTFYFGFRSPNQTRVILSSSDKLGHFTFGEYSLH

SEQ ID NO: 24875 - protein, 68 aa, Candida albicans
NKSQGCDLLNCVILITYSSVIRYCLKHLGESAFLYENAFSLKLKHSVFQHQTNCQNKKKKMIHTSLVL

SEQ ID NO: 24876 - protein, 66 aa, Candida albicans
SPAMAAPSRPVVKIEYEVPLVIGGGAGAGASVGFNFFTGVDVEDADDALLLFWSPIAATVTTDGFI

SEQ ID NO: 24877 - protein, 60 aa, Candida albicans
ERIIRLFEFQTSLIHFSLEYRFKVPSICLLSRTFSKDEFQQVSNHNFVLFGMCICIGKSK

SEQ ID NO: 24878 - protein, 138 aa, Candida albicans
VVHFQKMNFNKFLIIISCYLACVFALANQNDGGDDDSKTKKTTTWVWVTTTIGGQLATISTAYSQKFISTHSSEDAKSVASGEIGLGSLSGSVGGIKTYSQTTITNANIAPSNNNVFLGIESLYTGIVGGIVLILGLL

SEQ ID NO: 24879 - protein, 84 aa, Candida albicans
IILQERISPIKGGINDTSRQEASKKCCRAFKNFKPSCLMDDRLIFPPRNVELDALPLLLLFPLRLSLFLLLVLPLLLLLLISAS

SEQ ID NO: 24880 - protein, 80 aa, Candida albicans
SSSIWCDSKVFENRDPSDDESNVLINTIIICIHVYEGVQKGVKLQRLIFDNCGKDNKNRQGVNWSIGQYVRIFFFFFFFF

SEQ ID NO: 24881 - protein, 252 aa, Candida albicans
LHNHITLYLKIFFFNVFIIICYTTILRYLSIDNTEFCGNMIRLIRWNNVQSLVFKRCLFVPSNSLTNKRKRRIPPSKPRSSNRKDGDIEPYRMTDQNQTPNTGSIARLPAEVKKELKDLRSFTKVIAQHLKPEQENDSLTSAEKPYTSQLPPIDIEEATDDIFGEISGTKKLSANAVPPPPPPPGLDIPDEIKERLGLLSEILVPAKTSNNKLPEKQVENNWKLLLSQLDQAGGLSGLSKRSVYKLFPENPT

SEQ ID NO: 24882 - protein, 67 aa, Candida albicans
ARLFCNSLNGPNKERRENVYQIELQHQIKSNKSKWQNTRQKFVSKPVLLLTIYSDNANGIYQHACNL

SEQ ID NO: 24883 - protein, 77 aa, Candida albicans
TFSRLSLFGPFNELQKSLAHNIGVNIHYFHQKDINQINKILDIKWYPLFLVWYLKIRAVCRKKKRFLTQICLKKLNA

SEQ ID NO: 24884 - protein, 104 aa, Candida albicans
NIIHSNGKLEYDLWEFKNYIKMPMDPTIFFKRFNSLHQQSINHPFIQIVIHSFVTDYNSFLYYRLSFIPLLPTIIHSFITNLKLSSTNNVLEKYLECSCFRFIN

SEQ ID NO: 24885 - protein, 67 aa, Candida albicans
VFSLYFILFFFILDCLYILLILVIQIYTQLKFFLFKYIHAVILFPETEKESNSIFIVFLSLFQFIIT

SEQ ID NO: 24886 - protein, 61 aa, Candida albicans
VLKQALCTRPFIATPVKSNKSLMSHSKLNQQILFNISLSSLMPKQCVADSIIILRAVFLLK

SEQ ID NO: 24887 - protein, 233 aa, Candida albicans
YKTYLKLVPLSIMDTDTIAYFDSKLDKVTSQLNIDNDKIVDLQQEIVLLKQYIDYQNSKIEKVTSLIGNLLEKKSQDEAVLNTIQALQEDVDVGDLQRQVDQLTSHHSLGQSQQQQQQHQLLNSQHRQQPRQPNEQQSLQHHQQPHQQHQQQHLHQHQNQHQQQHSQRPSHMLQDISTQLESNMDPALHQVAVATAAVQQAQAHSQSNEPLGMASLSQQRVSKPTKKQSRKKV

SEQ ID NO: 24888 - protein, 85 aa, Candida albicans
ERYISKRESKKKKKSQWLKFGAAKVKIFIFVRRKKMMELYGKKSISIGAKFIRPGAFYTTTLNSDPFKLDSQNEKTVSRAYRVGF

SEQ ID NO: 24889 - protein, 74 aa, Candida albicans
QKWGESGDFPTLNLKQIKVHSGMIHEKLSIFIAHTFDKVINQHQLIKLIIANQNETKQKNNKSYFHMSIKQSSQ

SEQ ID NO: 24890 - protein, 73 aa, Candida albicans
VIIGKRRPRNEFDHKKKVADTTRPECHADQETGARRGDQKGRGVKNIIMPLLTIKDDSFAFCFAQVHMTRAKG

SEQ ID NO: 24891 - protein, 64 aa, Candida albicans
SICCGLASCANQLVCLNNHRGQSVKSTESSNLQLFLVALNENNTLLCSIFLHISVGKYRYLVLT

SEQ ID NO: 24892 - protein, 86 aa, Candida albicans
KPRDKKSCKNVQIWELLHSQREKIMLLSFSLCHLISPDFVQPPPKSFYLKDSQIFYFLASISYYSFFFDNIKQPSISKISSPNWVG

SEQ ID NO: 24893 - protein, 65 aa, Candida albicans
TAREKKKIFVCMFYELPSFVRQYSSYQERKLIKNDEHLLKIRVTSQVLLFGSDSDEETLPRSTLS

SEQ ID NO: 24894 - protein, 83 aa, Candida albicans
SSNTLSNFNWLLKSLYLVKRTDNIPYPLKLSNSFSNRQLLDNNVSNRDNTVYTMESRSLEFVISSDVSRIRNTTDDPPITLNA

SEQ ID NO: 24895 - protein, 160 aa, Candida albicans
  UNSURE (3),(5),(9),(11),(14),(30),(40): Identity of amino acid sequences at the above locations are unknown.
DLXDXGTEXRXGEXEQEQEQEQEQEQEQEXEPDQEPDQEXEPDQEPDQDQDQEPDQEPDQDQEQNETIKKSRPFDELKPSTSETNNQQQTTQFNFDDEDNDYDYEAEVEDSNIRKQRLLSKENNSNKLVHIKSNGRQEVTSSPVPIETDGDTDVTDSNST

SEQ ID NO: 24896 - protein, 65 aa, Candida albicans
CRFAVCNKKKINHDNITSSRRMSQYYLPAPSYSLTHSINRKINIRRITSTDDQEDQKQIFNEIKI

SEQ ID NO: 24897 - protein, 63 aa, Candida albicans
YQQNQYIMTLGFDKFISKVSTHRRQSEPSILEIAATNSQNKSRKLSMDNGHGYVRESLIIIII

SEQ ID NO: 24898 - protein, 93 aa, Candida albicans
GIFVDSACPSCSLKVPSFNINRIFTTQRAEYLFSSLFSRLVKLQSKIVVDHPSNPNTSLAKLYNIFREKLVRLSRDPNDWNVSLECCIFSNFI

SEQ ID NO: 24899 - protein, 78 aa, Candida albicans
YGEKGDSKQKGGSNSEFQRRERRFRYKHPMGQGKGKQGLFDRKGGIWGGKGWIPIVEHPTVENSKWNIRVPHKWCHQW

SEQ ID NO: 24900 - protein, 61 aa, Candida albicans
VEESHITMLRNVTCCLANIKINHTHSPFSTYQLKRINFYAISLNSKYNDRSFDLIIKSKVV

SEQ ID NO: 24901 - protein, 66 aa, Candida albicans
LYNKAFHTLNTHIHISLRSQSVLQLIKYSITRGRESYGFAFCNIRLLTIVRIDHTNYKWCKFQDVK

SEQ ID NO: 24902 - protein, 83 aa, Candida albicans
  UNSURE (36),(66): Identity of amino acid sequences at the above locations are unknown.
IVFPELTTITIHTEKNLMPPINASILSSGKARNANXNRTGLQKIKTDMFNLNSIPTVHGLTFPLNXAPILAQSNNIPGELFLH

SEQ ID NO: 24903 - protein, 72 aa, Candida albicans
KQLRVKYQKMESLKLSIREINKQKITKKSKVEDCYLVNDEIEHKMVFCICILLLRYTHTIRSNNNNKELLLS

SEQ ID NO: 24904 - protein, 61 aa, Candida albicans
SHVHTHLFHSLLLITHTILFFLGSRTMKKKKENWKAKQKSRAAKKTTKAKEEPPHKYFLIY

SEQ ID NO: 24905 - protein, 67 aa, Candida albicans
LCPPQATGSKHTGLWLLIQASHEYCAISSGVYRYGFDEDKTVEASPKTNKKIDTNMVYAESCVMNAI

SEQ ID NO: 24906 - protein, 118 aa, Candida albicans
DGVLAQHFGLIHIPLQRTMCLAQELRRSLSKKKRFDFLFGATPPPPTSIFSATRKKKRGTTTFAATCYQRINHHNMIRVKASQNILFAPFFVDTNKEMQLQLDIVLRKYEFETLLISK

SEQ ID NO: 24907 - protein, 67 aa, Candida albicans
IYNIINLKRTPLNKKSNQKTKKKKKKSHALSVYYIYIYLYKQLICIIIFIIVELHCKKVKYHRYLYY

SEQ ID NO: 24908 - protein, 75 aa, Candida albicans
LTNKLIISNCSNRNQIPTIIMRILTKARAFNPHLAEMFLNKIPYYYSRAHMADPEPCPKILDKFRFKKLNMMVLN

SEQ ID NO: 24909 - protein, 98 aa, Candida albicans
AHQSSNSIRIEEGTTAMTQANREKDILFSTNYIYFFITLFLVYNMHILYHLFWFNIITHLYTHCRQLTIQIFQYKRYCHSCGIVTTHKFLAMSIFPYI

SEQ ID NO: 24910 - protein, 329 aa, Candida albicans
SILLVMSLFPTQWIAKSIPFLGQEKPCIYGFTYNSECYYYGLYLCNFENVWKQEVDKQKLVHIAKTIGIEDMSDDDLVELINDISRYIPEKMVFEQDDVNVRARTIGDIEWRFNLSRQNQEQTIEFLYKLNYQQFENICFMKFQVDSLKEIISVKDQYSRFLATNFKQSHGMDMINNYKKNNQSDIEFIERFSPKKWDKKVVSQYRNLQSKNNRSSINGLKICIETAINTISKFASLFSENEAKEEEQSSPVKLDPVEDSQLVKVSPSPSQSDAQSTQSANSNSMGSPIKRRISTYELLVPTSMSQASQSSLDTQSPRKKRKIGSLFKK

SEQ ID NO: 24911 - protein, 185 aa, Candida albicans
SEHTQIINTEVMGFGQILLFACSILYLSTGGRWTVVALVFVLYILYNKDQQQQQQPPQPQQLKPSVPPLAKPKKESPIYAVDFTFSSKAFTPSTTTTFPIRRVIAPRPKRSPKIFTASKPIVQQQQQQQQQQRQPVLTKTTVELKKCQIYIFYTTLTGSSQRIAKSLYAKLQNFQQQRQDPANPP

SEQ ID NO: 24912 - protein, 74 aa, Candida albicans
IEFKKNYTMYNGRHTGLTNSISNNTTSKLVGDFVRRPYPIPLFYFFLVFSFSFNFSSFQVCLFVCFCSKLLVFY

SEQ ID NO: 24913 - protein, 73 aa, Candida albicans
SNQKINFQLPIEEPTTATGSTEQQSQQQLAPNSPQREQQQQQSQSQSHHLHQTSIRFKLNHIEKELNKLNQLI

SEQ ID NO: 24914 - protein, 87 aa, Candida albicans
LCNQDMHKLTEALVNTFEEFLLKIQRKWLQLMITYIQNCKNMFEANLTNWKEFKESLVNETREVNYINMSCICYFISSACFDIYLFN

SEQ ID NO: 24915 - protein, 117 aa, Candida albicans
  UNSURE (29): Identity of amino acid sequences at the above locations are unknown.
TPPPAIVSYNNYSKYTRHLSTDVFISTSXILYAFNQILVSLDATRNEIVTAVTIQHDIINFNHPFIATYAYDFIGAWSILLKHHPGKFSAQLQLNISSLQKLANNDDIDKLCTYINT

SEQ ID NO: 24916 - protein, 92 aa, Candida albicans
  UNSURE (83): Identity of amino acid sequences at the above locations are unknown.
AAFKVSLAMFRPITPIGRVLSDYLAQAIRVGLTSSNTTHHEFDWRTLPTMLLYNRHPRQPLCLTTTIQSTPATYLLTCLSAPXRSYTPSTRS

SEQ ID NO: 24917 - protein, 177 aa, Candida albicans
INLTWLIKKAREKFFLLLLLLFFLTMSLRERLREVEESPNTYTHVLQKDIARVETFIKECDKAIAQLDESAPVGTQIIALYEILGVIPYTPDKNDTIGTAATTVVLQSMINRYTPQSTTPIDFLEIIADLNHLRANKQTALADLQSRNFASPLPEKLAEARELEKLLNSYIAKINNQ

SEQ ID NO: 24918 - protein, 70 aa, Candida albicans
PNVIVQSTAVTRVGHVKSNVTDKLHVPHATNPKETVSTPSPDNEMPKSQIENSTKRPTTRYQQSRKRSRL

SEQ ID NO: 24919 - protein, 111 aa, Candida albicans
CNLLRVIDILARVILEEQTNKRQGIHKTQKKIKLLRIKERKEKNLFIKKNTTHDNERSFNNQTNFHPSTNIFNKSFIQYYFKNNSVTRSFDLLIRLIYPLFSSYNHTGFSS

SEQ ID NO: 24920 - protein, 103 aa, Candida albicans
EMTYLIELIDIWTVVCEKKEYVKSRHITFYTQLVFFFSPRLTTYLTFNYFLASFGDMCVSVFNCTLLIYQKKRIVAERNRDHLILKHRREDASRQSIFVVNYL

SEQ ID NO: 24921 - protein, 62 aa, Candida albicans
FLNFLMTNSLINRYIDTVTALVMKIFLLFLLKNPANEEKIAIFLSYKYIFSHIADWADQSLQ

SEQ ID NO: 24922 - protein, 67 aa, Candida albicans
QQIFPMIGICATLHDMCFRAFKLFIQNSRHMQIVHKLRVWYKRNKKCQIFYIVIYFNYGKLNVYSVL

SEQ ID NO: 24923 - protein, 122 aa, Candida albicans
  UNSURE (4): Identity of amino acid sequences at the above locations are unknown.
EFDXEITEVYGVLNSHGIDHGSSDVNKQTFPQWGIASESVEGKSTQPKTNEFNQVFEKHLHRSSEIRQLITNDVDSPVSVNSDSTSNVQSIEPVDTYSSAEIDNLLGNIQWFDQWTDFNIDF

SEQ ID NO: 24924 - protein, 61 aa, Candida albicans
SRFHVIRKKKRYDIVNIRPSSEEEDIGLCVCVCMCVTNKRGAKCCIVVAFDSIKEQIALPI

SEQ ID NO: 24925 - protein, 468 aa, Candida albicans
LGLVAALILLCCCLKRRKNKNNENNTNDNDEYFNEFKQPRKPMPPINGIAGAGAGAGAGALALAAGAGAIVATSSNESIKDESTMNVFKLEHNYSKSSSSLTQVETSSSESFYDTHENTPIVKSWRANTESDSKLARISNGSLATVNTENLFLVRLIDDYSVRNSETSSKFLSSNSLNALLRRESLSNNNSNNSTNFQRLDSNGNIVGELNFNNNNNPKSNRSSLSEKYMTQLSSPLPPPSLPQLQANLHIVPEEKSRDLSHTGKDETTGTISNLLLQFNDHRSKVSDDEFNSSSRVKQQRRQRHQHPLSRENSFSNHYDFDNRLPSPNYALGTNSSTMVSRSSDTFLLDESTPINNNHISNTTTAPTTTTTNSNPNNNNNNQDGQTMQHQNLSAILLGSINSDKFFFDKNHTNANKNSPSSTPYSLNIGKSAKLVDFTRKGSLRESAYEPDYIYTGQSASIQIDDSD

SEQ ID NO: 24926 - protein, 72 aa, Candida albicans
QNNTSQKPSQKQKHSLYKDKTKNNISNSVLYYIISYHIISYSNHYHQSVSMLIDQYIYNQAHKLILLNFLFL

SEQ ID NO: 24927 - protein, 64 aa, Candida albicans
FMGTNKAQLYIFVHISKQNYNLILAPKKGKSISIRDKDNFPLKHLGINKQFLKLFELEELKNIP

SEQ ID NO: 24928 - protein, 222 aa, Candida albicans
NGSTMQNICRKQYLVVESVYMLPNARRASFEFFLFAQKKNYSPILKPFLLGTRSSRIFTHGSKTTSTVFEEKKSTYRYQQLIFLFLLGFLDFVKNCNSLFFLYANEELNYLRLLNMPPKRKKLLKETKLALLSKKQSPIVTTRRRRSARKLSHENKNSPSRTQKIEDDIGVDTQMSEEIASSLNSSPIKQIDRRLNNSTPTKNTLSLVSQSKTRKTLHFQKT

SEQ ID NO: 24929 - protein, 91 aa, Candida albicans
LCLNYSLYHSWLTHYYYVGVLAPPPEYTINTGARYLYLRSSILLLFIRLSSFTTNIHTKRTNTHTQGYNISSFYRYISTRSYNYKYLFIYI

SEQ ID NO: 24930 - protein, 60 aa, Candida albicans
LSTMELSYCVYPLQLIVSSAGRCKDVAKKITTYRWIDTSKAVLFRIGAYKDGRLLYCSMF

SEQ ID NO: 24931 - protein, 62 aa, Candida albicans
ILVPELSPKFYITLTPSKLHKIQQTTYLFKAPNIQTTTNTNLFTLLKCLNQNTSQNINVFGV

SEQ ID NO: 24932 - protein, 61 aa, Candida albicans
NKKSHNKKSSWKANRGGIDYIKLFVRILNYSSNNILVDFIQLEVFLLLEKQPILNFRRFIV

SEQ ID NO: 24933 - protein, 61 aa, Candida albicans
FFIFQLKATAPRPKAKMPQHIRLASKHYSQIHKSCAYLFRLTFSIAIIEPTFKLIPLNTTQ

SEQ ID NO: 24934 - protein, 82 aa, Candida albicans
LVSKKLGEQTSKGDTNKMVQSMDETALIAMGLLIESWCEELITDETARHFLTTHKDDPTILLSDEESDSKVNNEDVQYEHEE

SEQ ID NO: 24935 - protein, 64 aa, Candida albicans
RSKWLLIYGLDIMFSIQGWGVVSSVHPVDGTMDNPDSIKIGNEMQPGSDFLISFEENILPFNFT

SEQ ID NO: 24936 - protein, 113 aa, Candida albicans
NSDMPNSAGGNFVTPGQELVDTKFDKIYEVSDKLPKLITIDAKELPFGKDVVIQTIRKLTGESLDGEIAVSYLDTPEETLSEITDVGRYQVKLISADGKDFVLQTLDVEEVSK

SEQ ID NO: 24937 - protein, 74 aa, Candida albicans
LYGHCLIGSDHCPVFTDCDMSDEDEDEDENEDGNKTSVDLIEQPKLSFEAKNHFKINKIRDITSFFGSKRQKLQ

SEQ ID NO: 24938 - protein, 81 aa, Candida albicans
TSTHLSGQQLLCASWLSFSIYWVIAVGYLEQEDIIEQSEIHNQMLNNIKKKLKVINLIVLRPNRVFILNVSSILLFVQFCF

SEQ ID NO: 24939 - protein, 64 aa, Candida albicans
IYVLLVLKKFVVRGGSSVAHLEMESKHQRTKKEKSKKYNYLVEFYPPSPTLLSTLFKYDMFNIW

SEQ ID NO: 24940 - protein, 61 aa, Candida albicans
SLVSLTKPYLPLRGEDSLVKIIRLDFHYFQCMCYILVFLVILLWFIFYFFSLSISMVVTFY

SEQ ID NO: 24941 - protein, 106 aa, Candida albicans
  UNSURE (2): Identity of amino acid sequences at the above locations are unknown.
KXSRGCPITKKTLGNGNGTSSYRFPLYYDSTTNEKVIMSLGNQSMIMNQEFEYGLKLLNKNLVILIDKIQSLMIGDGSGNYDSHVPIECLDNILWNLKYLELFMTV

SEQ ID NO: 24942 - protein, 92 aa, Candida albicans
KVVAEGAALKKSLKIAVVVIVETVFDVEDVVAVDSIAAVVGIAAVAAGAFVVVVVMVLAVVDLAALDTAEELVLVMVKIARVKNLKLLLLNQ

SEQ ID NO: 24943 - protein, 64 aa, Candida albicans
PVIKMFLKESSYPIGFSTLLRPTDAPPKNISFVLDVAPVDALLDIILYQSILLTCSTSKAHKGG

SEQ ID NO: 24944 - protein, 64 aa, Candida albicans
IYFSLKIIRYHEFALFCFEGYIFSLGLVEGLDQYRNHLYIDGYVEDMSRFNTYNVDYFPTRKLE

SEQ ID NO: 24945 - protein, 123 aa, Candida albicans
TSQPLFTSLFDLKNKFSLKSTHLVMHPQLDKNRFNTCDKLMDALEECHRQEFLKQCLGMCNFEKEQLIQCLHYQRVEDSKLRILETREKRKNWELKKKQAEEEAYGKNGYLKKVLEAEVASKK

SEQ ID NO: 24946 - protein, 74 aa, Candida albicans
WTDGNSYQGRYFSPVAATTPTFFIFGSTEKKKDRSRSGQRKKKKSITGGEADNDPHFFSTSIRCFVIIIIFLFI

SEQ ID NO: 24947 - protein, 508 aa, Candida albicans
KLLKEGYNVGIIEPTDGSSSAGDKFEAIITFCTWHCLRAFNKTINKLITIQNRTNNEQISPNEIITEVDGEMTDEEFINQIATQGVVAQSNLTAGRNKEEIIANQRIALSYMVELKRKKAIEEANDFLHVIEATFREYPDFVAYAQKTFKTTGKYWLNCHFGNYRELTNNCVKSYHQVLKTKYFERRRKYRVDRVIWMFIEPIAKYYEYYHSAVIVTSLLRYIDKAEEASKLKAEAVSDEDMRQMIVDLPGYIAVKSFNGSNYYKISFGERGIFSCECPYNEYSIDWCKHIFLYKRYKVAKGLDIPFVELERNPLADLSGLNGTNEIVERETDTIGDESEDEELVDSESGFKNATYNESDFGDDNFDSMENDPDGDEPDFSIENTEPTEVSQEETEEEIGARLARDRVDPGFSIDDDNIGNDFELADSSQVFTDGGTAYYTQNTESDPFIEWPISETIDLQESADVILEIESIEGVYAKKAARNIKQREENYSSLDTELKRIRFHTRR

SEQ ID NO: 24948 - protein, 292 aa, Candida albicans
KRKRRIDAFIENVQCLQNYVRDSSNSKYTYYRCEYCKKNKGVKSKKTDCKHKIAVHALEGGKYKIVWHFQHNHAFDPRRITKATRNWLMDLASTNIPRASSDSRRSVTKFKLSSFLLSDKFKISNKVFNYYKNKNKESQAHLDKNVIKSLKIWVSYINTLNEFAVFKKRPTNTENAEFCDVEADALNPESTWYFGIILLSNLQYMLSPQTVFLDSTHKLGHGPHNEDIITYIFITKSSLSGGGIPIGYLITNRESHEPLASFLRFFVEKKIQIKRFVIDCSATEIKAIERRI

SEQ ID NO: 24949 - protein, 77 aa, Candida albicans
LFLQVPTRPPSSFSSSSSHFSVFNIIKVVYQLVIPSIIRPSSILEYKTITKITVTKQYILTDNYLNSNSVRYYYYYY

SEQ ID NO: 24950 - protein, 67 aa, Candida albicans
TMFNGLRKVWSLAIFQRNLFIYNDVINKQQQQQQPPFFYPFYFPFSFRDITTNTRIKGYFIKDGFIK

SEQ ID NO: 24951 - protein, 78 aa, Candida albicans
SLLKDNRNICGVLWSVISFSMIQFIISLYHWKISLVLIEHLSDNITGNELISPASSLCVYFLIDAIFKSVDLNPIMEC

SEQ ID NO: 24952 - protein, 84 aa, Candida albicans
INKQISINTIYLYFDNSIFSLREKLCIIMERIPLSVFEKFNNQELLLDVPEDRFISKSLQAPEIFSTPSEDCTYFTKSNNSNIL

SEQ ID NO: 24953 - protein, 207 aa, Candida albicans
LTTMSTARVYIGVFFRFFQFVGNVGCFATGVKTLRPYNAFILTVTVLNFIYNCYIWFGVPIIGGLKAYNGILLGGDISFFFLYIGSSMFQAFAGYTDDWTEDDFGFSFNPYCYYASWAIGVICAALYIITFIMYVCWGLIPASRYGFSTGFCERPPFKFGCLVFDKSQVDHDCENNNDIDLESMQHSTSNNTGTKQNEVEKQESIVF

SEQ ID NO: 24954 - protein, 87 aa, Candida albicans
LLQQIVIPKDRFLLFDGGFGSIEVDPVYDTDPNTFESLVDNLVTNRNLDIFVSTNNQSSNCDKEEAERKQVRRPESNVSLHLSGGNN

SEQ ID NO: 24955 - protein, 80 aa, Candida albicans
FGKYYSSLALYSCLPQHYKDRYGTHNNINKNILVDSAWFSSTHSSLLHIFTRGKKKLTIINNYHKSKLYDLSSRGEQCIF

SEQ ID NO: 24956 - protein, 87 aa, Candida albicans
GQTTEKCSLLAIVKSKTNTVITPFNIRFSRSFHEVSRIGNIMPWTFIPVTLQSCLEGFSAVVLCANPAELSRLAINQISVHVSEICL

SEQ ID NO: 24957 - protein, 284 aa, Candida albicans
LQAVVKIYDIYTRCILKLYLKVAKEETRNMFYEKYKNLHNHLRLEETFHEFFFNENLGFDPSKTYQALNKLFRPFWIKSNEKPNRTQANAADDATSNQMSSTPLESLSSSSGILYGNSSSSSTSFQPPMVHQRNSVSSHQFDYTQDFPHNGGKPLEISYLVHPQMKHFDAAIGSVTKRNGSPNDKELSETFDPQAISVINAAQMQQQQQQQQQQQQQQPPFFTPPPPPPQQSLLPSQYQQQSQQQQQQQEQPLSNRFNSNFTSLEEMIEENYVGDLNFPDIFYN

SEQ ID NO: 24958 - protein, 63 aa, Candida albicans
TIVVILNDCCFPVFMLAFYCFGRLTFGVFFLSFLFVYTMIVLSTKYAITTVVTTNQSITKEGQ

SEQ ID NO: 24959 - protein, 135 aa, Candida albicans
RCEDEEDGSNNSNDGNLFSLSFNSSQKKSTLEKAKLTSPLKSTGKRSRKNSFKYKPTTSTKDTGAKSRPIFYNFDSSGDSSSEEEEQEDQDTRKDDEEQDDMLMTKESKDKFVLQKSENKVDGDSDYFWFGNNNK

SEQ ID NO: 24960 - protein, 101 aa, Candida albicans
VPHSILYITLLTMSSVIASNIPSKTTPAQVKEFFESQAGEVYDLIPLADNGKVQKFEVLFKDRKSVYTALDLSEAYIDEVAIRVNEVPELTDGQVGKAPQQ

SEQ ID NO: 24961 - protein, 73 aa, Candida albicans
GNWGMGERGEIEAGINYNNYRITNIINLRGLICRRAVLCNVILCNYKIYPIEDLILIRSPLLSNNQPKYTLMI

SEQ ID NO: 24962 - protein, 60 aa, Candida albicans; identical to SEQ ID NO: 21998

SEQ ID NO: 24963 - protein, 82 aa, Candida albicans
PFFINLSKKDPSFPEEHSTSRPTKSNILLLSNESLPNIFLSSINLQSNFFALDKRSSKLYDLIKAPFSYNEIAILSSLIFPK

SEQ ID NO: 24964 - protein, 64 aa, Candida albicans
CIHQNNKIVFASCFTVQHNNIFNQQKDICSYAQNIDGMPFRYLSYKADQITYPYISLVFLSMIS

SEQ ID NO: 24965 - protein, 113 aa, Candida albicans
  UNSURE (110),(112): Identity of amino acid sequences at the above locations are unknown.
LVFLHHFDCMTKEPYYISNLTSIKPSNNRNYSIVSPDLPSLTNTQLKYAPPLTTNIDNSTNIDVGNKARKRSIEPYYSKPVKIGVLPPAILNQFAYHFHSSPRVEDPRKXRXP

SEQ ID NO: 24966 - protein, 67 aa, Candida albicans
DVITQQNNAQYDTITNERRYQNINQKQPTKKYSPIIHNNATVKSIGNSDDHLKRKGFIFTNKKPKLN

SEQ ID NO: 24967 - protein, 64 aa, Candida albicans
DYLLSHLAIQALIYVYFSFINTKILLVRQRKQKRECQHKFEKIKLTCGLCIPSGRDFFQSRAAP

SEQ ID NO: 24968 - protein, 167 aa, Candida albicans
FDTTGLQTMDIIKKKYPFWKRLLHKWQSRRDIPFRKKFFIGYDLYGNTYWEFTIDGNMSRLRRKLEPFRKELFEVDYFKTIPPQWLQWLRRTREHSPSLNELIEDQIRQQRIKILAQQADENWKLEKLRLEREQPLKLSNELNKVKLENEKSIEKQKRKENEALLRG

SEQ ID NO: 24969 - protein, 274 aa, Candida albicans
WNIKLINYSHYLFIIMVTINYEPLEHLPHIDENISPEERSHVEQLIRLELANQFNNNIQHITHNDENMANPNIIVEQQQQQEQQQLLVPTPMHPLVDQLLPLNPNIQPTSIMQLTQERFEEEFGDDDDDDDGDDKHLPPGIDLTKYTQFNITSPLDEEGNQSILDDNNNQQINYTNLYTTLGHSALQHRNLELLIRNQTDLNQLQQQDLARLDELNTELTKNINNKRSMVDELKTNRKRRQLNELKPLQEEYEERWKQSINTAIESSINSINQK

SEQ ID NO: 24970 - protein, 73 aa, Candida albicans
NFFLYRIVSTQNLMILYTRYIRFNISKVDITKVVLIRNQFRAINIPTEVIKYVWVEISHLFLFFSIHPRTHNT

SEQ ID NO: 24971 - protein, 107 aa, Candida albicans
KKMFAFKKSTTSILKTVVAPTSSRYLSTVTLRSIPRTFHNATKVSLFNGLRTTPRFYSVLTESPEAKVYKYADVKDVAVHPEKHPDSVFRGRLENQLNLEMVIFQEL

SEQ ID NO: 24972 - protein, 65 aa, Candida albicans
LDRWVYIYVHVNVLYNPIINFDLNSASYIPIGGGVGLGISLSLLKELLKQLKENFLSHFFFLLWN

SEQ ID NO: 24973 - protein, 105 aa, Candida albicans
TGINFKKLLLCSINTVNTELKNTKRKIIRTTDTYALLHEKNLLNSLWGRVLEIDMEGGYERNIVISLRSTKIRKHQDGYGVLVGETRGNTFAKTLLFTEFNVIKN

SEQ ID NO: 24974 - protein, 109 aa, Candida albicans
SVLFEEEVITINHLLREREEGQMYKRANWGAKYSEKAGKESCGRSQRKSLSNSGGYGEGCRNSSKGNLMGLEPEKGSILGFSSKMGGSRGEIGVLLKIKKSMEDYLEGK

SEQ ID NO: 24975 - protein, 99 aa, Candida albicans
FSINAPSLVSFFLFLFFYIILTTISNMSQDNVSSTSTAEAVNNEIKVKDEFPQEEQAHTNFRIITQLIATLVTSLSFSLLPLGGFVFRFQYWLQFPGCI

SEQ ID NO: 24976 - protein, 115 aa, Candida albicans
VIFMQVSKSYARPHLSNYKASRVNLVKNKRNYYAFHADTDLRQRNFIRTEHSHRLHTIEAFFFLNCAFFSIEQELRKRQTIKFNYFVHLVTKLVLFFFVMVRVNPKSLFITTPHA

SEQ ID NO: 24977 - protein, 61 aa, Candida albicans
FYQTRLIIRKKKKNTEKLMQMHKKELVFRARKKNFHLLKASTSTILTQSPYTAGISSSQIL

SEQ ID NO: 24978 - protein, 118 aa, Candida albicans
ELVVFPFFLTILFHFAMGEVEWCYGDIRMYAVLVSDPEKTHKKNLNLFFSSSFLEIVHIFFRSHHLVWKLEFLQLLPNNKKSKRTTSIRYLYLHTDYIARVFFSTNNDIKIISSVWYP

SEQ ID NO: 24979 - protein, 79 aa, Candida albicans
KIIFILAPQQKWIFNTHTDLIGANPAHSDRKKKELNWCTWLISSFGFRCGCFNKLFQRIFIYDCRRDELQTSFWLTLFQ

SEQ ID NO: 24980 - protein, 100 aa, Candida albicans
PIPQKNAKKVNNHWSLWGKNSKKIQVSKTKLPPAAKQLKNTKIQYEAILFMTPVKMVKSALNNNVKLKAKRLPIKSAENPQNSAPTSKPAANISFETGYL

SEQ ID NO: 24981 - protein, 72 aa, Candida albicans
HCSTLVLPPPVKTITDIVNSSLTGKRITGSKKKRKKKFELCNTLITINHPISILNNAGKITTRLGNKFQSVV

SEQ ID NO: 24982 - protein, 65 aa, Candida albicans
QLREIEFLLVKTHIHLRTDSTLYCDLVQILQAIGYSARLYLRSRSIAVWQFREYITTGVVGFENS

SEQ ID NO: 24983 - protein, 342 aa, Candida albicans
RPLATRCAFEIGKEMAESTTTTYYRLNNVHLFDPDLVNPSIKELYDELYGDIDDWIDMEPAQVTNNYRQYLLIGYVSKLLVIHSQTTLYIFLPVLLHWLSHQNPYLRHLGQLLANDFFSFPDNSTTNIEELNGLKFNNTSRIFWTLYGVDYWKPFLNRASLSVVLPYKISLELFDELEDTHQLPKGYYRRELYSMFQICLNYNIIVMIMVKILQKTRKKCKTYEDAYQHFKNIYTLAVEMACNWLPFYSITFPNNKIIFNSLRQLQEFMQGKLKVLSSQGGKYTLLYKRSQGFFESLEAILYYYLYPDRKIILNSVDTVAKTAVKLRIDNHKFLAWLNRNAF

SEQ ID NO: 24984 - protein, 121 aa, Candida albicans
TILFIYLSIYLSNTMHSPFNFVSCNILIASFATDSTRTRFISAMTLFPISVSLTNPGINALILIFPLNSFDRLLVNPNKPALDAAYTEVPGIKCSVIDNTEEIFNIVGSDPFWRSIFFTTI

SEQ ID NO: 24985 - protein, 73 aa, Candida albicans
SVASSSNDCCNMVSFLDNNDTAAPSMANFLLIASPIPRDPPVTNAVLPLNIVKMRKHTYEENLFKINLVIYLK

SEQ ID NO: 24986 - protein, 74 aa, Candida albicans
NDETVNEIDSVTLPKTLKNIKLNKTKERDKLNHIMKKKKENKKNNIKNRGQTIQDSTLPPYSIRYARNRSIRCS

SEQ ID NO: 24987 - protein, 60 aa, Candida albicans
KKERKTQLVSIQLIVRSKKETDIYNHIFNCGTYPDLDYRLLLLVFPSYKSHSIVYDKMLT

SEQ ID NO: 24988 - protein, 314 aa, Candida albicans
LCMAQFHSIVQSNGPPPTLSGSRISTQQHNIQQQPGMINTSFNGNQQVDSNMTTGLLKISNLPPDLTRREATLIFALVIEEMLSIEIKDYQIYAVFKNINTCITTGKLLDGKYIFGTDYPPIKVEYENSTLLGSPTNISSTQSAFNSLRLSGPPNTNISPPNLPHSQLQHQSSSNSIDNGNSSLTGSFDMLSKRQSIGNQRSRFVFSDPFAQDQLQHQLHQQQQQQQQQQQQHHHHHHQQQDPHAKQEIIGIQPAGSGPPSVGPAPIGLSDMSGKFILLMESPNDAREYENLVRDSWGPTTGNSGVSTVSAKFP

SEQ ID NO: 24989 - protein, 398 aa, Candida albicans
IQTNMVSRSHSSTPVPIDADHPIHFLNIGNQDQIASLSKQTPIILLNQQEENGFQTPELVALRNSNKYVFVINWLYNYRGYLKLQSELFDIDLFELELLGFFNAFDLSSLFINKLKLVLITSVQNSKLVELEDFEFVFRAHFGDDSPLGIQTDNEQDSVKFDLLNITEKFDILYILINYISKYSKFRDWTEKQGLTTRLDPLFKLSLTEYFSLFDDNRLYKRTITYYPLTIPKKRKLSPESPQDYFDAEVFDVKDVKFELVYKNIYEFNEYLSKIKKSLAHKLLYTKLAGKSSTIIDTIFDNEVKKRRYLINKRKEIQMVNLLAVRKRSSRLEAKERQRQEELERQREEESKQAAERRFERRMKLKNTENMDTGKLSRDQRMQLRQLNYEPTPEPDKA

SEQ ID NO: 24990 - protein, 81 aa, Candida albicans
DMSNPQSIKKTERRRSIALLTKSPLSQSPYISPSPRGSAPSSYVANSQFMRGDTESVAMESTSENLPRIFTTGVDGPALKN

SEQ ID NO: 24991 - protein, 60 aa, Candida albicans
DFVSKFSCFACSAHPPHPPRFIWSPELIACLRYDLVVQFPSTLKKSTKISSLQPSVEEGD

SEQ ID NO: 24992 - protein, 91 aa, Candida albicans
VYSCRRVNRCWWCFKIHNSVLFFPPLSCLWSMCTTNFTTTQLQERRKIARIYVLDSINYNISIQHYRFSILISPNLLISFSPRGWQAPRLR

SEQ ID NO: 24993 - protein, 61 aa, Candida albicans
RGSYFSKASGVLLIFIVCYNNIHGLTLAASPVHSKTSSSTVLALFSMRHSLPFHLFIEKSS

SEQ ID NO: 24994 - protein, 223 aa, Candida albicans
IVNLKTPPTAVYPSTTINSLDYLDMTEIHLDQTSQKIPDPVKFVSIEELHAFPLPKALESLPPSVFQQFLESKDLLQGYLKQLKAYQEKQLEIIDQLGELDNILENVIHKQLIKDYAALVDKINQQIKSINIIYQEFLNLETYQYQLLSNNFNQDILKLKFKKLLEKTNQDSLNIVKNYHEKGESTDDDFNNMIENFKESRKLYHSRKEKLHRWEEERVSGFV

SEQ ID NO: 24995 - protein, 90 aa, Candida albicans
FHHYIYSIMFTRSLIKGGGRLATTRSLVNNSTSLVLKNQFKKYSTSTPPKVAKSKSSTIGKIFRYTFYTAVISVIGSFSPRGWQAPALSD

SEQ ID NO: 24996 - protein, 63 aa, Candida albicans
TRFNVVIIINANNVRLYQILYRKEIIIINLIKLPFESYVKLKLERHQEHTDTVTTKGRRVSPS

SEQ ID NO: 24997 - protein, 67 aa, Candida albicans
FKIIIKNGYITSPPTFLINNNSTTTTNINNNNTNKDNDNNSFFISRLIRVIVWIGFGLGYSFSFNLF

SEQ ID NO: 24998 - protein, 74 aa, Candida albicans
KFIIHRFMSTFVSILVFCDIYSWIKKENTRMEFLNSIIGFKLNNEPILTIVGPYCTNSLLFQYYLGDLALLNTQ

SEQ ID NO: 24999 - protein, 202 aa, Candida albicans
TLSITVIKNFQIMAYATTSASTNTVINNNSNSSNGSYYDDDIFEMNLEDNIPSSYIDYENVNNYTTTTTNVSALTKYRSTSIIASGNESSLPPSPLVLPQQMSTSPLQPYYSYTYNSSSSSSPYSTFANEDQDQHDDDQFLYECCICKQKLNNSNNNSHNCTRDLFNGNTLKDNDLIIIENNKLIQNNYQKWLYNITPNIPY

SEQ ID NO: 25000 - protein, 79 aa, Candida albicans
NTSRNNSIDNDLNVQNDVINRHGSVVNALSGTNNKLTNLSRFAESKVAVDKIAIHQPLVIGGKLAKIASINKSSKKCDY

SEQ ID NO: 25001 - protein, 99 aa, Candida albicans
FLLLISLEALLLLLLGVVSYFQLTRNLYIDLASLTRPTRYQFSIVFTKELNYLHLKVFNSSDKITEVCHFQILRNMTNIVNVCRECNLEITNQLTYRLI

SEQ ID NO: 25002 - protein, 89 aa, Candida albicans
GVVVVVVVVLTLYVFTYHDDMRSNYKKGSNFKLILFQNGFSFSVSKYVFHLIVSTLVRELLFFEKNLLTVAKKQDLKPIKQHSIQNLSL

SEQ ID NO: 25003 - protein, 88 aa, Candida albicans
INARSNKMQNPATTVYVPPTFIALIILSKTPAPKAANQHLIKLRQLVDPLPLLGYKSTNMVVQIAIKTDAEKDTKIVEIIMDIICRLY

SEQ ID NO: 25004 - protein, 64 aa, Candida albicans
HLDSNSVDNELKTIVHAAKCIPTGNSVQKTFFWKKIFKGPNKSNLVAGTIVVMSLFILFLKCGR

SEQ ID NO: 25005 - protein, 103 aa, Candida albicans
IYGDLFKMFLGTTDPFPTNFLDVSGNIKIANINVTPPPIVKNINIDLQLLNELIKAAPTNPPIPLPTNCKPATAPTILPRLALVHTSPATPELIEMTAAIPAA

SEQ ID NO: 25006 - protein, 68 aa, Candida albicans
TFVCEMATQEAQNTIILASITGLLPNVSAKLDEIVGAMPWKIKYATTDIFMIDELVWKYDVNVGNAGK

SEQ ID NO: 25007 - protein, 65 aa, Candida albicans
LIVVLCLNDEISLTTSKISIRGRMQTDRKRNSALKSKLKSKKDKDRICKKSTTFDNDKKESFSMY

SEQ ID NO: 25008 - protein, 130 aa, Candida albicans
CIFFFNCGFLSTRYFVSDFLSSLPHHVKLTSVDFHLVYSATTSRIVIRDFNFIRSGLHRICYLIDTSYYILIHGKAPVYGNAAQGSAHNKLVYKVKFEVTSKLRMVLIVVVYSIKKPIICLYNVRITICC

SEQ ID NO: 25009 - protein, 84 aa, Candida albicans
NYSKLEILNLNIKKWKYYFLRQKNNTLIHKQSFKCKDLIISFNKEGDSPKCEVEKEEKEKERIRIHLIYKQREWFQYLYILLIY

SEQ ID NO: 25010 - protein, 60 aa, Candida albicans
LKYNSHCELARYAFTERLKKSIFGNLDLDNRAENNQRHTKNNVILKSEHTSCSNQLVSKL

SEQ ID NO: 25011 - protein, 60 aa, Candida albicans
NFFFVEKSNSVNRKSHPALLLLVEVIPLFSVAKNGFIHDLGSSNHHSLSLTRYTLIHNSC

SEQ ID NO: 25012 - protein, 76 aa, Candida albicans
LVSALEKVNATRVQKGEFISCLLGEVQLQLISQKNHSISKPIVTKIAVLVEIIVLLVQSIVLLVFQCIRQLLSLFI

SEQ ID NO: 25013 - protein, 66 aa, Candida albicans
KHLHSLKLLSNWAKVAKLGTCIISRAQPTSSYRSTYFTHIDLRILHFSLISLIIIAPLHTYSSLQF

SEQ ID NO: 25014 - protein, 63 aa, Candida albicans
YFFLSLCNEMRLLSDSLMLEKKNEETHYKSNKRTTWLSAVSVVRLDFRQGSKCLAKNCVISRI

SEQ ID NO: 25015 - protein, 217 aa, Candida albicans
SLLCQTIMVQLALFTNNNHNNNSNNNTTNTLNDDTQYDSTTMNTEDTPIIPDKTDKLNGLDSRSLSRNRTRSISFTRFLFNSNNNNNNNKDHTEQSRCPSNETLDNSVGSPEQQNSGFNKLKKMFKTNSSLTQEDGKNSGRTRSASTPLTPPKVKKETSVPVITTTKAPNKEETTTTKIHSPPESPVVQSNPYFQYQGVPAHTKTSRKVLTSAEIHV

SEQ ID NO: 25016 - protein, 210 aa, Candida albicans
LMIFILFKSSISKLLVLLLNARSISSTKESDSQLYNYSHNNHMIIPQSSSSSSISVSNTSTIAFYFVLITKLIIGYFIISIIIAGFKLLKGQDQCYDLPLTIHQRKLLGLKVNDVPEDYIIDEKAEMILKQRRYDLLKNKNNDKNKDKLVNMVNNQQSIPKYKKLNDYYCSSYYDGINNNAEEEQEQLQDSMFNINPQVNGKYNDGALIK

SEQ ID NO: 25017 - protein, 472 aa, Candida albicans
LKNHLVHTPLASITQPKPLEMNSNFKRFRVLLESNLPNLQNEKSMIEINDRTTVKQLKQLIIAKNDEGSVTRTFIEQIKLSYEGNIIPTSFQEEEASVYELLGLNQELLEQNNSVIKLKLTKHEHVNGTGGLLSREFWKDFQSNDRFRFLPATNDSLQQPNLALSNSVPLESTSDLSAARSTTNPTATSSSSEQGIDSDISTSPTSANPVPSPSNYETLVPSQQDSIPFVNNPSESSTPNIDPIKPASIQVRGGSTWEMEGTSYDTMVEQHSGKKILVKQDDLSNVEYELTLKVDNIVKKVSLGTAQCIVVDNGLHDPYLLLGPMGAAKVHKVFKLASGEPLIQKVLVMMYDIGSDLESESNEQAVPGDANNIDVEDAEIDDLMDRLYTNGRLLLITMVKLTFVLYLMGFRLNQHMMNYWFHYAVLLVLLFHAYVLLCTGANRVIRFGGNVNDVSIMMDRVVRTCVRRTSEL

SEQ ID NO: 25018 - protein, 68 aa, Candida albicans
LVQSRDPAWLKTVKLNFENIWKDSLLFGLCIFPSMQARVFHQLSLAEEDVSIYEELVEPNEVVDLVEI

SEQ ID NO: 25019 - protein, 145 aa, Candida albicans
FRQLQKKIKAREYYQQNYNIQFTLFLLFSSLVLILHIFLTLMSTSSFESAAYPSTVPALSTANMNNSGNVSANLSVTKDSGNTTIGGSGDIPATSDKKQSVFDIAENIEKDLNKMLEQLNQTDVEINKRIDVALKKVTSLYDKFN

SEQ ID NO: 25020 - protein, 61 aa, Candida albicans
FFFVTGGIRSYAILKSKETVNPDERHVIASFHKQNHVTSHIFYKNSILHSFCSILTINAYK

SEQ ID NO: 25021 - protein, 83 aa, Candida albicans
ITVFLAINYIIVNLVLINIKVLLHITLQILYLTKLWKLLLSSYRRGAKYQFYFLDKNMNLKKKPSVMLSTRFTNNHLFLEAEY

SEQ ID NO: 25022 - protein, 60 aa, Candida albicans
YTNTHLKTFRLYIFNIKIKKLKYHASNSEDMESGLIIRLMKNSYQTYATLQKKCQFSKFD

SEQ ID NO: 25023 - protein, 81 aa, Candida albicans
IFDLFVLLLLLLLTNSYNQIFSFTSLFYFFFFIHLPTSFHFPFKAISVLLITFTESSNSNSLPSFASYYLQAIALLLSIIV

SEQ ID NO: 25024 - protein, 171 aa, Candida albicans
FYFIQFRIAIHTLMTKNKHNFTLNNSSDGVNNNDDPSDHHDYSDDSMPPTPTISTFNKFPRQSSLRFKTPLPNDTPRSSSLGSTSNNNNHNHNQKSPFLDENEASFDRKFGYNYDKDKVVEEEDENEDEATYVVGEDNEDNEDENDNINEMDPSNLKTKRHRWGTTRHKTS

SEQ ID NO: 25025 - protein, 64 aa, Candida albicans
FHRTSLKIFLSFFFSQPTTHSHLVTSRKFNTLQTLVLPPPRPSLPPYQLRDDSPAFPTALGSSI

SEQ ID NO: 25026 - protein, 401 aa, Candida albicans
PLDHCIVVFSLTSIMGKDTNKPVVTKLPLDKALLLINKKITTVPFYNKVHIIKSESQNDDNNSSNDRIPFDSLNTRTTLISNCANLYQIILNEYTNRFNSNNNTEDSQNNKGGTHIEAIPMENIPNGEYHGNKLTFNANNGIIELWINNNLFMKIPNLKNKYDNKKGGGKQGKEGQFIKLSKITSNLRHEEFIMKYKIDLKVNNSLSLTNQLIKSEFKYIIELLFDNVQCIIYNDQPLPPRTLKDDNSMDIDNHDSNTPTSENIFKIIKSPELQPMINLEQYDHHQQTEQGIGLDEFEKYELLTLFTNFNYNQNILKDQYYNDLPHFNSQNKHEEDDNTLYVCSKHSLLNVLSHLLTLETINDWQIISFHYRNKYHLLIYKNPSNNNDVYFTRSSPRVEIR

SEQ ID NO: 25027 - protein, 64 aa, Candida albicans
NISILSRKKNRRGVKGQSVKNPTKLSSPLGNGYNSDDYIEQVSRETLQLHDNEKTVFNKRRRLI

SEQ ID NO: 25028 - protein, 66 aa, Candida albicans
KLWLNIDKFFIYIIYSGIFYLPLQKQEKEGKRRSNNVPLLQINVYSKFINCSSLVLIILNGGDKSE

SEQ ID NO: 25029 - protein, 88 aa, Candida albicans
EYFLVLVDDEVLLLFLLVVVEVVVVEGLIILAILDSRFTFNSDSDSDIILVVAPIPVPVVPVDRVLFDVVFVDASSSKKFHPGSLPDG

SEQ ID NO: 25030 - protein, 100 aa, Candida albicans
GLYIFLILQPHTHKMHRVHTYIHTYIHYMHVGTIIKLPKAPHSLSLQFFFFLLFLFDFCFIFDSESIFRSCSSLQPKLAHYTVLLLLLVKNSSSVYSHEI

SEQ ID NO: 25031 - protein, 68 aa, Candida albicans
  UNSURE (48),(49),(57): Identity of amino acid sequences at the above locations are unknown.
QVVFCLEAISKVSRGILPLDYLCGKELDNEWKDNLAATFRDGRKYIDXXKIGRFSLXYGKMFYKSQTG

SEQ ID NO: 25032 - protein, 84 aa, Candida albicans
FHFKKYIHISLTIIMESRKPSLFNQLEPHNEDSDATDISDISEDEDWEDDPPLSPKSQPLECPKLEHEVATSTSSILTIMLNNQ

SEQ ID NO: 25033 - protein, 68 aa, Candida albicans
PTRKNTSPLSPTHKHTHQSLSIDNNNNYQEVFFLIQCGYCSSFFPNAGDDDDDDGKPSLVFAGKFIIK

SEQ ID NO: 25034 - protein, 83 aa, Candida albicans
FSHLINFSIKEKEKEKNKKVKSISQKFNTLTFNLTLLLPTIRPHTIHSSIYPSIQSDFFDFVFPLEFFFSDFHIFNSFFLIPF

SEQ ID NO: 25035 - protein, 71 aa, Candida albicans
FCFCLIAKIGDAQLLDMAGHKMSAFQIVLIKFTLHKRGDEKSSLLTISDIANNQVYTEIYVQQVSYCLLIT

SEQ ID NO: 25036 - protein, 64 aa, Candida albicans
LSTDVTINTLSGKTKKNVDKKNPLNKKKKRFDTQKNPKYRFVPGSSLIAARGTLRKNLHDTYHT

SEQ ID NO: 25037 - protein, 145 aa, Candida albicans
NGPLPYFQADKKKLSSHDHAMALKKKIQKKYTYFFTQDISTKPTMSKPELYDQYMITTLPRTPDLELSDKVVVSTIKSIDTSIIDIGVSKSTISSHITKPTPKLLWSYSLNPTTIVECMDVLAKEDKKYYVCGLSDIKKFRLLLI

SEQ ID NO: 25038 - protein, 61 aa, Candida albicans
DILITFLLFQQISKLSGVAYSSIQQKKKGRISFLDHNKVSPLLLIYIIIKSSSTDAKQINV

SEQ ID NO: 25039 - protein, 120 aa, Candida albicans
LDMVDFETPISIIDVSIDFIVDTTTLSDNSKSGVRGRVVIIYWSYSSGFDMVGLVDMSWVKKYVYFFWIFFFNAIAWSWEDSFFLSAWKYGSGPFYTQILVLSATLLYNKKLSYPVLYTL

SEQ ID NO: 25040 - protein, 64 aa, Candida albicans
VLNGISINVLVLFSFSRVESKVIAVTLYKMNFSQCSAEAYMFQFKFKFSRGNFINSIQLSYVLE

SEQ ID NO: 25041 - protein, 63 aa, Candida albicans
ITPEVVLKNGIKILYVDPTRMISFCLAALETNCLELGNRFKKKKNHSNHFSVILLDVLVNHLE

SEQ ID NO: 25042 - protein, 111 aa, Candida albicans
TMPVPFEGLLPYAIMTAFFGLAGHGVQFIRYWDNGWKNDRYHLDEWDDKMMARDLLLTGVKRGQTSEAVAPESFKTAEKIEQRYWTPYRDEYFTLRERLFRGYAFGEWELS

SEQ ID NO: 25043 - protein, 63 aa, Candida albicans
SPVKDLRKVTHKYIQPPITLFSLDYVPCSDCLRNPYSTTYFYSSTIPTFLKQKSNTLSETESF

SEQ ID NO: 25044 - protein, 87 aa, Candida albicans
NGNRKNSFFTNNKRNVVTRNQVRIYKEKKKKKKGDRTTNNSSIIMSTDFNSFVIFSFFFVQKLLLAGDGKEIQQHQYMFSADCLVIE

SEQ ID NO: 25045 - protein, 413 aa, Candida albicans
QILIMISGHLQTPDLSDHSGDEAKLTKPSGLELKTNELWSSDLEEELESRIMQPATFSSILKQFPSILEETIISKIMSNKNCDKNNWKKKIYCYRYFLQPLKEEPDVGNMKSLVEKLEKLKLKKWSALEIEQLFCNYLEDLTTSAVKVSIPGKTLDEVAAAVNNIHPRPRWTRKEIECLIKNENDFKKLEKDLFVRDLDSIKKKIRRDNLSIQNEIQDSEKKSPQSTDSNNKDSSRDLSRKERDQLKKLLSKPICFSELLAKFPGHSWEYIAREIIQLDSSEDNTIWLKKIYYYCVVYSISVDKEITKYIGGGNRIYEKVRSDWSKIKTLDFFKDWSLQEFERLYCFAFHDLTKSALTKNFPSKNLNDICKVVNISFPKVPYTDREMKYLERHLDTPMQTLENNLPFRSRGSI

SEQ ID NO: 25046 - protein, 73 aa, Candida albicans
LRLFRLYIYIYTVGTGKKRKNKKIHFLTGGLKFLHKNSTSCFIFRAMGRPKQEIPFFASAFAFAFVLFSSSLD

SEQ ID NO: 25047 - protein, 70 aa, Candida albicans
TTLCLLGSNGRAKATIPMTPIKAPQIQIGTADEVSEYQAIMGTIAVEILVINTHKQFPVALAADGITSGV

SEQ ID NO: 25048 - protein, 358 aa, Candida albicans
DADLPAPWAEDKQVIDCSSGVIIGSYDETKTKPSTVEKRIPLPPIISDESFINTSACCTPKISKGKSCGCCNNKRKAVNKSKILQNYIKNKLNQKINNNETLVFMNKSHTTNNEQKEDHQLYGMVPVPSCSIPGTCCCDDACSCQGCVVHGNSKYQIPLPTLKQQVTDTTNPFENEEKFIFNSMPQTDKSDLFFNTISTSSNVPPADSSSECSCPPNACDCTNCETHGILNGFRLDDYFKDQSKLMNVLDFNFSELLGTIPEQPIPTEFMQPPSENTLLTSLSLENSFIPNQTKELSTQPPILPLDAQNVCNELDQLEPLVPLLQPCDKKATKWVNNRDTLEDVSDNRVKSCCSKKTK

SEQ ID NO: 25049 - protein, 70 aa, Candida albicans
VSQLVQSHAFGGQEHSEDESAGGTLELVEIVLKNKSDLSVCGIELKINFSSFSNGLVVSVTCCFRVGSGI

SEQ ID NO: 25050 - protein, 64 aa, Candida albicans
RVLDEVCQDNDNNDDDSIVIQMTFFFFVPFKESVQVIPEVDHLTYIYNETGASITYKFLQKSIL

SEQ ID NO: 25051 - protein, 71 aa, Candida albicans
IEENDTRNSQIVKVATTKSKMRMAKQIFKNVACLCTPLLFLYSMFITTLLELQSQLKKLIKKRNNNIFVSI

SEQ ID NO: 25052 - protein, 76 aa, Candida albicans
RRIIELNKPQKTGKGKERQSKYIILINKKLMLCCKSEIKSKQYLELLMCFELVCFELDQIKSNQIKSKRKCCCFFF

SEQ ID NO: 25053 - protein, 62 aa, Candida albicans
MSQKTNYSCCFVIVAKWDFLKLNFRITCKCHKNLTISIHTTEDTINQLQLTHLTPFPYLFLF

SEQ ID NO: 25054 - protein, 64 aa, Candida albicans
RIRIRHIYIFYFLIFLFTLLFTLYSLHLLSQDLNDTHIQLLQLLIPSHPFFFFYSTFILVTNYQ

SEQ ID NO: 25055 - protein, 292 aa, Candida albicans
  UNSURE (287),(288),(289): Identity of amino acid sequences at the above locations are unknown.
LLITNKPIYFLTFNRKSKISIYNNYHIMVKNHLTTTTTTTDNSPITNNNNNNTFLSNKPRRKSKSSIRNRNHHRHGKSLSPNLSTTTTTTATMATTTTTTTTTTTTTSSSNARPKPKMIKRRNSSFANSSSPWYRRNSFLSKSMIQNEIFQVYESPYYYTTTTKRNAAYSIISLKECQGFIFNQDLFATPFQQLRSLAIEKTRLLRLKKQQRQQQEKENKKKNKNKNKKGSEMIVQNDHDDDDVVVVEGDCFRRHSSYHPMRPRLISIVENNHNHKDKRNSIDNDNXXXDEE

SEQ ID NO: 25056 - protein, 75 aa, Candida albicans
KLKTTRWGQHNKQINNNNKMNEASTGNYPALHTILIIFEGGNELTTVSRKDYGENNTSCRGTYNIEFSTKLNHLA

SEQ ID NO: 25057 - protein, 541 aa, Candida albicans
QFITYLRHFRFDFSLLIYFLSLGIYIYKFAPILLTPPMNVDFIQYKTKSNIKGNNNYDDGNLTDDENDTNSNTTISTSISTSTKEVKNTGQVHHQLYTTTSNPVGSLESTTCPSLATTSSDNTSSSDHNYLSASELTLVPPNTATNNNNPPPNWLKVNPPPKLTSLPIDIPLQIKEIAPEESTFSSSDSDECMNSYPNTLNYNQPANFAMIYNNAQLKRQQQSILLNQKQQQQQQQQQEQGQQLQQRQQQQQAMLLSPARDYNSLRYIANKKVDSPMSDEFFFQDNYPLDVKFQYQQSIIEFLNYIIGKYKEMEQGINSYMDWWNVYAFKRQTLDNMIHIAQGFKAMIISILKQLSVNSGIIKNGSQSKNEAFKQRSLDPSYINNNTTDSDDDDLINYNVFQFVYNCSIENVNIGNLINCSLFTNTFKFNLLSYYYKLNYLLINVKDQKNWLVIPMEIWYKLPSFIKIINDNLTKINKPMTRDLEITLVKLNSITCKFPTVDNLKKTDPIGSWHDFEKINRLLTEKFPDYTEHGQVQEFPV

SEQ ID NO: 25058 - protein, 71 aa, Candida albicans
IFSTKRQVRVIITVELETICFLKFGLLAGRIFLRATNVVGSKKGFSLNVFYYNEQFDSNNQIFDYLVENNW

SEQ ID NO: 25059 - protein, 288 aa, Candida albicans
IFRVLFFNSVPVHYFFFFFLFFICFENIFGCKFLFSLQSCTNYPYLIVTANLEQLPRVLNIIYMMYNTISHPYLQQGQDIYNSCNQLSVSDVTTARDSTSPNFKTLPPINLKQSTTHIPVKISFPSNTISPNIPDSQITNTLATITDIVSPQPFFSYSPQDQTRIAIQKNLKLAIEEIKRTESQYLSNLKTLKRDYFEKLIEDIHLDVPVPIKIVYNILAELIQYHDKMTKLFERVDDTNIFKQCEGYCSIIAENGINLFWYKWYCSQHQIIQDLYHEFSQQSDRYGS

SEQ ID NO: 25060 - protein, 75 aa, Candida albicans
LDLLLMMIHKSNQNNKAYILKLKNMINCPIVIKPCQSIHQLELTTSQKDHTLTVDNIKHIIKYIIKLYTEKITKP

SEQ ID NO: 25061 - protein, 78 aa, Candida albicans
KVRVSPFSISILYSSHRNASKLGDMSLGDEIGYMVALVDPSFSSIAYGSIFISISPVDLSISSPGVLLLQVDIDNGVL

SEQ ID NO: 25062 - protein, 85 aa, Candida albicans
HDLFKDCKEYQSLYNNNKWRRFNGGGGQMVITKKKTTIIINIPAVNLSPGKPTSPTMINPLKLYLNKNSLQLGHVLLKDYIWFQN

SEQ ID NO: 25063 - protein, 73 aa, Candida albicans
SCCHNLKIYQIVKVLLRCYLIYYKEVILSNCQIKTNKKDAKTQNKIKNMQKCNRNLKKTKQYKTNYKKIQYKI

SEQ ID NO: 25064 - protein, 61 aa, Candida albicans
TAWKNFHWEPTVETVPTKTKKRMGAITMGGKPNVGGFLGNCALGKGFIFLPPPKKIFHGPK

SEQ ID NO: 25065 - protein, 71 aa, Candida albicans
PYNNSLKVPMGNWKLDRAYNQTKGVTITAPKATPTRRHHHGMNNESVANITKRVTNAHKKRIAYQYNGTSS

SEQ ID NO: 25066 - protein, 82 aa, Candida albicans
VLEKGALSNIKYVVGIKEGIKTKNKLKVQISRDECQPVTYMTIVKHAERMTLLIGILLLSINYRDDVTPTEYTKFHNIKCRK

SEQ ID NO: 25067 - protein, 77 aa, Candida albicans
IANQVVLNSYSLLLNGYNNVYSIIKQNSNQFKLVTFEDYHYAIVTRQPIFNNTPKGKVHNHTKHLFLILSFKYKVPY

SEQ ID NO: 25068 - protein, 65 aa, Candida albicans
FLLSTLEVKSCFNDFRGLHNSDYVITTLHFLKYIPHFPQMLDFIVSISLHKKWHSFDYNRHLSST

SEQ ID NO: 25069 - protein, 67 aa, Candida albicans
HYHVTFLELVIGQDCLKLRSFSSTKKVNPWHDTRSNDINSRGQLANTSLALLISCYYFTTSLNTELS

SEQ ID NO: 25070 - protein, 61 aa, Candida albicans
HDLFYLPEFKMVYKSMYWVCQSEQYKLNKTWKFHINLLSLFVFFLPQLLFSEISDKFKISE

SEQ ID NO: 25071 - protein, 88 aa, Candida albicans
KDNFTCTYCLTENLKQKQITIESTKPYGTLYNANRFNRHVYYYPIFMEKITLSLDNCRGIRLRQVLSYQSFNNRKLLFKHCLFYKSLS

SEQ ID NO: 25072 - protein, 371 aa, Candida albicans
LGTNDKMCLCMYQAVVSLRPISSSNSFNQVNGTHSLPTSHSSFSVRAALQEGAASTHANSPLLTPTSSSAQLAKMQQSYYSKVNQRDIHVSNDLKSEVFHPYKKKNLFGNSKIIGLIAFGTPKKEYFVNYVPLELLLSKSKKVSPSVLDIPFDLTFIFGDEKTGSVSSLPEFKSLSVELIALTVKSKKLPIPVVIHPEMMFDNKTKNGGSSNDNFDILTIKKFQKYAVELLKLLKEVGPEPLDVDRDLVLDIKCLANLTTKYVHMKIKDVVIKANEQSYTSITAVPWQKEVLKSTDSTTGKEQSTVKYSKNLNLSIDLANTVMKPTNLTDFCLVPDFQTCLMARIYYLKVDLKFHTGEKITLRVPIVLQKT

SEQ ID NO: 25073 - protein, 98 aa, Candida albicans
  UNSURE (3),(37),(94): Identity of amino acid sequences at the above locations are unknown.
PIXIQFLQRVGWHLFQIEQLVLEFPLSIFKTKQQETXATPDRISILLLADGNSSSNNFGVIKQLEENNNEDQDNFFKSLTKCITILNMIERLYXRGGN

SEQ ID NO: 25074 - protein, 76 aa, Candida albicans
RRMKLLFMNQKLIQMKVPLILCLNKMKNKNNTLPDIDILHNQPTTPTRIYQTQMKLYIYICIETSCSIIVHFCIKL

SEQ ID NO: 25075 - protein, 89 aa, Candida albicans
KERGLMSLKKKRLNFLCFRAKGIRRKIRTSRKIKKKILLPHVNVKLYNIARYTLERQSGTTGLTVNLNITTWGKTILAIAEIIQQLLTI

SEQ ID NO: 25076 - protein, 216 aa, Candida albicans
YITMQFSSAVVLSAVAGSALAAYSNSTVTDIQTTVVTITSCEENKCHETEVTTGVTTVTEVDTTYTTYCPLSTTEAPAPSTATDVSTTVVTITSCEEDKCHETAVTTGVTTVTEGTTIYTTYCPLPSTEAPGPAPSTAEESKPAESSPVPTTAAESSPAKTTAAESSPAQETTPKTVAAESSSAETTAPAVSTAEAGAAANAVPVAAGLLALAALF

SEQ ID NO: 25077 - protein, 79 aa, Candida albicans
KIHFSLEKKRVYQFIQQLTFSVNYSYYYSLVNNSHYTRRDTPIPIITTRTKKPIVIAATDFHIKLTYKRTNNFLRLYRF

SEQ ID NO: 25078 - protein, 513 aa, Candida albicans
  UNSURE (325): Identity of amino acid sequences at the above locations are unknown.
GSTAPMTMKNVYSRWPQSVHKCPYIQQQQQQHQLQHQPLLHHSSSVAGSTTSIVNNSLSISNGGYGNNYSKNLSRSYNKYSNSQVSQLLYMLPPQTESSSTATIASGASVSVKREDDTNNGSNAPTGNENQYVNAINHLHTSSYGGQGYATDATGIATPAYNSYSQANTSINTSLQQQQQLQQGQYGQYVQYGVAPSTISGATSTNNNSGNAPNIPQDVYYSHYTGFVQPHYPQYHIATGNASDQYNTNAANHQYHSNNTTSSANNNSSSRTTGVGSKRKPSIVSNSTSGSVSGGNGNGNNYGYNPNSSTSTNRPPAVSTNTTSXTSGGSSFSGPSSNITTNSMSNNPWFNSSTNMAVNSNYITSSGGGNSHGGIGNNEYEPMPMTNNSASIPAYYQQHVPSHVGSAQQHQLQQQVAGVGAPHIIHNHPYLHPTYGQGSNSASTGDNSTPGGSSGSGSGGSGNNGAGGSSSVAATSGVTSSNTSGNIVTNGTLVAAGTDDAVGNSSGSYYTGT

SEQ ID NO: 25079 - protein, 115 aa, Candida albicans
IFMYSLQSNQYYKTPKNFNPLKELNRNIEHKTISTKKSDTTSLWQKRRNKIKILNRKFLEKKTERQPFKDNYSKTKLNRIYQDLCFFFSSSSSSNKITMISISLHLSSMEESYNL

SEQ ID NO: 25080 - protein, 120 aa, Candida albicans
TIIMSDRKKSESNSQVKNGFDKDYFRHLLDFQKRARLDDVTIDQYEHQINIIFQIANILQRDTRKDLDALYYLLDHELPTPSIFSIISLSIQLKKLQLLDLKLRVDSIHRSSTAMEITST

SEQ ID NO: 25081 - protein, 73 aa, Candida albicans
SLKLLSQNQANLHDPSFFTRKVFVRQNTTADVEREGIYTRLKLHSVLSPYNKEREREKKKTKQIRKNIELFSF

SEQ ID NO: 25082 - protein, 62 aa, Candida albicans
ARNGRKKTNANVLKINKCILIGGRPSTKKTKLYTIARRYKNMEDYLSSPTCHRNVTNYTILG

SEQ ID NO: 25083 - protein, 88 aa, Candida albicans
IWVLATSTYVVLYFYSSYDYPLFPQIHMPKGLMPCQAYDTTRQPFLYVKCGNSNNTPSSETIFLQSYVLGMRNTKLSYEFFRSRMEKL

SEQ ID NO: 25084 - protein, 192 aa, Candida albicans
LRIMSRIDHDVSSVTSSLQSDIHSQEEPVQYQPSAVNEPSSRRPSMIRRLSNSASSFFNASNITQESLVEDVEDDILDIGNENYVEEMFGAKQLSHAMTSKSSDEEEQTPQPYTGQQPQQQESSTGSQESKADLTGDSTTPPPQQPVQRRKGSIVSAFSNKKYSFWDKEFKSERIKIAMQVLENYVYLVLSS

SEQ ID NO: 25085 - protein, 63 aa, Candida albicans
LTTSIHSSIIYREYFNRILTFWTLFNYLFSLFFFIYLKTSIFSLAYSHHHFIEIIIQRFTIPL

SEQ ID NO: 25086 - protein, 426 aa, Candida albicans
DTEDHNKLNLKSDSYTSYIGHELDVPQFERTIFQHHDIQINVPDSKHSLEATETDMEISEILQLRKSYFAYPTTTTSEFKHTNITTTTTNLPDPEVVAAAATAAKSEEKEENTIPPPSPPQQQQQLIPSSGATEQKVNPVSQALKMNTSIKKLKLATSNNIDGATPLIINSPTVNEIKLPTNNSWVLQDYEQLFGTKKFHKEIELAKSLRFADTTNSVCSDLKHEKLIYISTRIINPGKILSFYLKHPPLPPPPSSSTTTTTTTTNTKRDLYIDLIMNNNGCNILLQLIKYIHENETLVESSIDSVHVRILAFYVHQIKVFLNLITEVMKIYQKIKTLGLFVRIHQYENGYVLGAPQEGKVKLPQKLEKLYLANELKLDEFFHLPASIKALGLHNTNLSSLSKFNLCKNLESLHISGETINQTNRL

SEQ ID NO: 25087 - protein, 65 aa, Candida albicans
SWILKLKLDLKWGKTKCNVCRFFSFKKKQKTKKTKKTKSKGNSETLNNNFNKMMMGICQGEDGCF

SEQ ID NO: 25088 - protein, 112 aa, Candida albicans
STLNIMADNKLSGIDSGISSNILLAKFISDNSIPLIILKSNVLKKLLPRSRNFKPLVDTSTKDDDGGGDDDGDDDGSGDLINLIWKFEVCNLFPYKLQDINFSFKVKLNLEI

SEQ ID NO: 25089 - protein, 92 aa, Candida albicans
TSLLAVSYTVNQSCSSLNIIGGCSIYKDQQRTMGATENYQFNYLLFKNLGRLIFQISRLAESGPWNETIDRPSDFHLRLFQLSFNPINKCIE

SEQ ID NO: 25090 - protein, 68 aa, Candida albicans
AKKKKRQKLHYPPLQQHNSNRLNFKYHNNQRKKKYLSDYYHHHFIFHFSDFIFLLIELSNIYIFNFIS

SEQ ID NO: 25091 - protein, 110 aa, Candida albicans
SKKRNVYLCQVLSRHCFLLLLRVISFCDVEMSHEISRLQTIKDAMRNEQKKKGGRTTRRTWPKTKNVELVILMRHSWYPDRERGVTRNIDLFFFHIEQKQGMKGGGKKLI

SEQ ID NO: 25092 - protein, 257 aa, Candida albicans
CIPLASRLLYPPNSNVSKMITDFGQKYNPDTEKNDHSSSVLKANSQNVKDTKGNDSKHEVLGNLQSDSTGQVTSQNPGNYLGEIEQMSPEELERAKTIMEEPKEGEETTTKLGVPDPNNSKFSPVTKNKPELPQIPLVGTKDKLKRFKFRIYSHNVKNGGYHSLVPGEQQWSDRLIPLVASIKFNTFPDNSIVTLQEVYKFQMLDILKELNRHEPGKWDYYGKGRIDGEEMGEFVPIIWQPTEWELMYSDTMWLNDK

SEQ ID NO: 25093 - protein, 64 aa, Candida albicans
HNSYRLVGVLKFLLDFDKKKIKNKKIKYKKQTCTLQQLVHTENDSLWSFLLMTWYSNYIPIALI

SEQ ID NO: 25094 - protein, 62 aa, Candida albicans
LENYLNSLLDFSELIKRTQNLAISLSTCFLSYFGNFYFPKFSLINSSLNRKNISTNIQIISQ

SEQ ID NO: 25095 - protein, 106 aa, Candida albicans
LLGMEDLDSKFNNTLLADKITLSGMVVLFDSSSWHILFSFVLVRLILPIDIGIISAYTLSSPCAKTVCNWQSLGHTDEFEESTQFARGVSDTALVGGITKLEMVRG

SEQ ID NO: 25096 - protein, 70 aa, Candida albicans
SRLRLLIRCAEAPVSKNKERLSFDLIWSDDAAHPKTSRGKESSVVDEMVSSVGEGLVIIVEFADRFVGGG

SEQ ID NO: 25097 - protein, 72 aa, Candida albicans
IAEYNDMYLKQEKLVTKLDLPSLMTSKTHDISKTRDVNGAATDASASEREIPTSAAFNAPQSFAPSPQNPTV

SEQ ID NO: 25098 - protein, 71 aa, Candida albicans
YVSVVFLDLIDSNCLLVLPQFSLIIEYNHSTRKINCRHAPSALSKSAISHLCRIIHKPSIISGDLVNIKPS

SEQ ID NO: 25099 - protein, 73 aa, Candida albicans
MHRNIELNSMNNYKHGLNLLGLLVTFWILFFVLQVIFVIYIFFKSTFEAIVIVLLYSCSQYNLKPFNPIPLNY

SEQ ID NO: 25100 - protein, 82 aa, Candida albicans
IIFLYNNRVEYSQLPSKYSKLKKTPLNDDFSQCTQLLSCKNVKKKQLCETKPKLSFTSMNCERPSAYQILLTLYIPNGSKGT

SEQ ID NO: 25101 - protein, 65 aa, Candida albicans
VLVAKFWRIKVGLNLFQPAFKNHNPIPITGDKGIYDKVLKNYFFDSILICWLFIQFLKNQSRNCS

SEQ ID NO: 25102 - protein, 60 aa, Candida albicans
SSMFSSIFTLIEPFQSFFLISAILSISFIMQQKYFYGCKLTPHKSNANNDLLLMIVLSKI

SEQ ID NO: 25103 - protein, 68 aa, Candida albicans
SLWGKQNQTVFLSMHWFGLLLTAMQGPLPTTNEPLLGWTRAVVLTTGIATGLATGFGFRPCSGIGHFP

SEQ ID NO: 25104 - protein, 71 aa, Candida albicans
PNQNRSSRNKEISIQLHIKPINQTSIIIKKQKFHLEAASIIKFFLDNESIYYQVLFIIEVLNCQRNNHKNS

SEQ ID NO: 25105 - protein, 90 aa, Candida albicans
QRHTSLHNSPEYFPPPSTTESTSCSIVPSPTSKHNEIHVWAFTIASTHHFASAMQSAHHPSSNQQTQPQRALTTASTAMTPPLSTCCSPS

SEQ ID NO: 25106 - protein, 63 aa, Candida albicans
VHVVHPVNTTAQNCFHNSCCISGLLAQQQSQDTHWAFTTPQIIYNKLTQRAFAFHVAFPTAIN

SEQ ID NO: 25107 - protein, 63 aa, Candida albicans
STLVGEFEQLNFAVGADTGGGTVDRLNEFEEFQELKNLLAKGRGGRTGGGKVYSFSKHSMVEQ

SEQ ID NO: 25108 - protein, 116 aa, Candida albicans
NKKLPKEEKKKIIIVASSSTQKIEYFKIISGIVLCNVNWFPCLKLILTQYFFFLFWLNKVDYLFIFDRITQTQDLIKNTTTIATATTYQHVKKPNFKENNHFLMNNNQLMAKRTRT

SEQ ID NO: 25109 - protein, 84 aa, Candida albicans
FTFFDQIVLPPHHQFHTVSFLVRSIIVKFVRYNINHTYSMNLQSSEFREAIFFTSFIYLIYNVVAYLYTSNSITYNYYNSIILT

SEQ ID NO: 25110 - protein, 96 aa, Candida albicans
YFILEANNLKLNVYHFSQPRIINNRLHVKNIVYLGRATVHGTVLIDNCTNNFKPNQATDIIASKVQFYFESVVSVKKRQFKQLLCQDNRIIIIISD

SEQ ID NO: 25111 - protein, 431 aa, Candida albicans
IMLGIISSILRWSISPVIFIYNLIHTIISHTIIIPLKIFFKISIYIPFLKIPVIIPLVYLLELHEIRSTDWILAQIELFSITTLHFLIVCIFLGGIVGTIAGINMSAISIVLSGEPIVSTPATTTTTTSIASGKPSMKTAGVDKSKLEQVWEKSLGTGFSNENEGLGIKKKLEEVIIPDILPNISKSRIQLKLKQQQQQHQQIQKLKEQQGITLRNPEFNDTQKLRNVTINEELGGGIDNDNNKINEIHDIDDIESTGIEVVGLEDDGYAYTGGLRNRNQYQYPSKQKITARASGHASLNLPQIVSATTGRKSKDVNDETSTDSKTVKFADELVQDQPTGTLLSKRKAASTVIFEEEQTEMEQRNLPRGVNILQESEEVSSTDEGALSNIPEETETETETETENETGTGTEEIEEHIFTQGESVTEDTLLY

SEQ ID NO: 25112 - protein, 74 aa, Candida albicans
QVFQIDSTMTDNVENKDSMITAYTRISPDSSDLRFIKIVKFQHHVDKTPTSIPFPSPLPNNTSASNHINLKTSE

SEQ ID NO: 25113 - protein, 72 aa, Candida albicans
KKSTLLGEKDTSTELSCLAIDLLYNAHFIGNTKYSNNLKLNTKHKRSNVFKIYILSSAILLKVHLNSNCMFS

SEQ ID NO: 25114 - protein, 81 aa, Candida albicans
QLYVFLNIIEYSTVNYTSIFCVKESNWISIILIFFACCIFSSSFSNVILFFHPKRSYNQSIMVNISDFFKNNSQSGSVCIL

SEQ ID NO: 25115 - protein, 61 aa, Candida albicans
CLNININIWTIFGWIECLYISSFPYNSSFNSSSSIIQSLIHIVYYLQNKQNKEFQFNQIQF

SEQ ID NO: 25116 - protein, 91 aa, Candida albicans
VGNSYTIHQDNNNVWNILEAIEKKRSKKSAHLSPLGKSPKTQNFLKSVFSIEANYVDDETEMNPVKFIIKLFITQRLHEGGFPPRKNVIIF

SEQ ID NO: 25117 - protein, 61 aa, Candida albicans
QVHKFFVLLIIMEVEKLRKKELMAAVIAIDSTKINSDWQWLAAVSYIRSCEGLDSAIKVFF

SEQ ID NO: 25118 - protein, 580 aa, Candida albicans
TRWSPVGQIGSNNKKRSSEPNKNKKLMKPTKPGKLGKPGKLNKIKPSNVDENIVHEQLENAFVTVALMTNKEFLEQIALDGRNFPFKHFKSDYLIDRQEILRQIPDMINIFNKQDMKKIEQIYQNLSKLDQDKSMHLQFLKQSFIDYKNDLLYLDQFLRGINLKFKQYRRGEVRYFFVYPTVFEHVHDKILHQYNVVGFDRSLFGMPLDKQLDKLVLPREFIQDLPQFDNIIELNKIDASLGFKLVEEQQFGKLIDSLWDPRMVKPLKELQKEYKERLNEQKKDKNQQLEKQLQPPLKSKDDTINGKQPDKKFIVIKKGGYRQIKLKESSLQYSPVIRRIEEEIELMINDLNKQIKTTLESDNIKVLIPNENENENDKNDKETITTFTSPTGSQPTSRIKTNFYEIVFKKKIYQGYLVSVERLILKNFNILPNYALLYHKINYPPLIKRKLLNHIFKIFLININEKFNYLQKIKYLTQRQQIEFHKKLIKQIKYIIRFKLLRYFDNNTLNQTTNSLKLNNLNVFHHEEEEEEERYDNNFDKSKQRQRKTFGGAHAVIFNPYTDNCFKRIIGFLHHIHHQL

SEQ ID NO: 25119 - protein, 75 aa, Candida albicans
VILISILYLARVINQRIGVPKLAPPFFFLLVDYTLPSPINSIPTLLFKKKKKQIESENFSNPLNKPHNQLIFLYI

SEQ ID NO: 25120 - protein, 93 aa, Candida albicans
CAFSDVTFSKASALQLNALESVTLVKIVSITQFINLLSMLLQKPIQNSYNIQLLNTSLLYVLLISVIRVCIYCHIKLAMLVRLSQVVYLQVCS

SEQ ID NO: 25121 - protein, 63 aa, Candida albicans
GVQNIVPNTVISIKIKLSLGSPTPSVISNPNRQLNNVTTPYASLNLVLTKCVQEIFDLTSTTR

SEQ ID NO: 25122 - protein, 63 aa, Candida albicans
FGIFLVFKSSIVFKAHYPIFSEVVQHSIRYGFVEHCSLAYVDLNNGSRVSRNKSISFKMTFHN

SEQ ID NO: 25123 - protein, 64 aa, Candida albicans
LMATTINLMTSIANTDIDVFVGLGKLPSDVIRTIVDYLPKCMLPELLYFPPIREVVLTTGEESA

SEQ ID NO: 25124 - protein, 74 aa, Candida albicans
CNIFINKVLFLVAPKRKRTFKTFFLLKVVDLKRIWLEMPKLRNITQFYMVPEFKKKIIPEVLEFQDQWVLIQKI

SEQ ID NO: 25125 - protein, 110 aa, Candida albicans
YKGQRKERYLGYLLYRDRVSIDTFSGRKLHSLCFLLITNYHLSCTRTNSHEYSVYTNKIFEISQSQQICLSSTETITTIIIRLNTLCRLFLSMHSTTCRLHISSHVLHIS

SEQ ID NO: 25126 - protein, 68 aa, Candida albicans
IRLLKDVLYVEPAEPSISEIYLFVAIIFSTHDCINDVFFTISSNPVVLVFRMKVDSCIAQIQGGRGWW

SEQ ID NO: 25127 - protein, 63 aa, Candida albicans
VILRILVQHCLVLFVMNRNKQTGFTIRRLLLQKEQAVTLPPPQKHILYNLCNIITSNQNITNK

SEQ ID NO: 25128 - protein, 80 aa, Candida albicans
PEFSIHTFSYRSFFFFLLDFWIILTKFSIYVYNDFQYKKKSIINYIYIILNSKNKLVLIESFLHLTLFTNLRKNGTLKNI

SEQ ID NO: 25129 - protein, 129 aa, Candida albicans
IHLNLKKFSDQDDQLFSSTSNANSNDESDTSAILDDLDLDLDLENDPIDESSCLLENGGDNGNGNDHGSNGEINNGSITKSSRQNNGEPTISRRKSTLDEEREEFTDYTYPGLIDPLDGPWVGFTGNFV

SEQ ID NO: 25130 - protein, 60 aa, Candida albicans
  UNSURE (34),(46): Identity of amino acid sequences at the above locations are unknown.
GQVILWFICYKLKLKDVQTCGFGALECDISFNVXQVYRRLTTPTAXTLNNVLFCLDCTTD

SEQ ID NO: 25131 - protein, 82 aa, Candida albicans
NLNNLFTLRKIKKNMNFNLSSLFDHKCKGNNNNNAYGFNYNCGFDTLCIRILILTFQRNLFDRKCCSWTEKLPNDQLPRVAF

SEQ ID NO: 25132 - protein, 60 aa, Candida albicans
  UNSURE (32): Identity of amino acid sequences at the above locations are unknown.
AKSIYIHISIHIWIMRNLELICKLRTKIKNNXGAVTTPSIDQKTHDYPTWLRSTHPRCRF

SEQ ID NO: 25133 - protein, 214 aa, Candida albicans
IYKSLLLNFSVSKRKQQLLFLQLYSPLRPNIIMKLSTLFTLATTISTLTTFTIASPVVVVEKRAINETALAEDIPTTKNNHAQTSYGKPFAIYQPKAFIISMFSLERDPWLKAMDFVHNITIPGLSPVYPDIHCTTNYTICQITTGEGEINAASSISALTLNPLFDLTKTYFLVGGIAGGETNYTTIGGVTFAKYAVQVGLEYQLAYEDYHKTN

SEQ ID NO: 25134 - protein, 79 aa, Candida albicans
INYCNFKLVDNDKLKQIVIALFPNRKTDKLLLFLLLLKECSDFPMERQNFSLSGKCIGSLSPIIKKQARHQIDKEIKYY

SEQ ID NO: 25135 - protein, 68 aa, Candida albicans
RIVDCKGLIYSSIGKKKKKKKNFLFDGKQTTRDIFKQSMRLERCRLVGSALLLNGVFPYKCMLCIHVL

SEQ ID NO: 25136 - protein, 62 aa, Candida albicans
YINYQVFLLCNFFFSFLDYFFFDKVISLVNNSKVGVVLIFQSFNFIHSIINLIIHSFLFSTS

SEQ ID NO: 25137 - protein, 268 aa, Candida albicans
LFIRFCFLHLKSDYSHYSTAICMSSNQTSPVRRSILSRKPSNFTNNNSPLGKRFNTSSRLTPSPSKSGYHRSSATLSPKKQTLGFTIWEDKVDKSNSTTDVVGTPTSNKLNHNDQENILQPKKVENKRFHNDRQPLSNLSINEFKGFISTNGAAPIQLTELYQPINFNNEFKSLHKQLNIPSYVTPSRRYRDKYLAKSGIDEIDEEIEDEMELLLSKKQQQRSTTLSAKPNNINKTHLIRKHTRSLTVGKNDSKLSLIRKNKFSILSN

SEQ ID NO: 25138 - protein, 61 aa, Candida albicans
QNVGDVNGGVAVGSETTRTLNLGCLFVDLVIQTDLTVVGDGSQGHTKTYGAGGSLILVKQQ

SEQ ID NO: 25139 - protein, 62 aa, Candida albicans
PGVGPQGRSECGGAGELTGSSKVHFPVVGEGDALQVIGGRGSGNTRVKGDDSVVGDGVEQCC

SEQ ID NO: 25140 - protein, 279 aa, Candida albicans
FHIQPWYLNRLFLPCPLLVSRSLLLSHHLSSQVNHSYSVHLLLPPNHLAVLIQSHSPHNLKPHLLLVPHWLLAVESNTELISSAIQSSNIQTEFTSTWTTTNSDASVVTESGIISQSGTSLTTLTTFQPATSLVVPPYSVIETEFTSTWTTTNSDSSVATESGVVSQSDTLLTTVTTFPPAPSAIVPEFTSPWKINTSIESNETLTVSASSYKRVCESLAAATSSSFSSATVVVAPSESEINTSSSILNNEEIASAPVSDTTSIVFTTNGWKTRVPVAV

SEQ ID NO: 25141 - protein, 82 aa, Candida albicans
SQEGQNRWAKKNLLWFRKRTSEPLKVYRSVSLLSSLLLSFLLWMWLIVSWSVSGHSIIYAPLQHSNLKKSLNLCKVNLLPLS

SEQ ID NO: 25142 - protein, 99 aa, Candida albicans
CYTSCLYFRQDNDDDYTKQDLNQLLWETFFILVSLVSYFSQRKAIILVQRIPFDQIDNSNKQSMKFFCFVILLIQLQCKKFQFSMIHLLNGIVNTPNEH

SEQ ID NO: 25143 - protein, 96 aa, Candida albicans
YYRLNFICKVHSKETRPREYIGRGQTIVKVKKKKSCHYVRFNDVFSQILVSFQLRFGSLLRLVLWQKLVHSSLSTILLTSISMTIKFRNLELRKIY

SEQ ID NO: 25144 - protein, 64 aa, Candida albicans
LFQSCVYVEHSSKIYFVIVLVAAVPDQVQLMSFINYTDNNNNISIVYVQALTPKIYQRCELIGV

SEQ ID NO: 25145 - protein, 62 aa, Candida albicans
LDEHYLIVTLEATLLLLHQVWRLIMKIITMVLLLVMMVVVVVMIFMVTFIAMVIMMAGIITV

SEQ ID NO: 25146 - protein, 231 aa, Candida albicans
KNKYAVSSSDISSKSSKSRKRKLSTSSSSSSSNSSLSDDNLTSNIGSTSINSTNYKLNYNSPPSEQEFDDHYYSSSSSSSTTTNSTFALSNQDQHNLSSSSSSTSKMDYYTNLANKFRIKYKEYSQLYNHLLTNSSTNDNDGSNTNYKKNLMKLFELHQLLSQWKKLLWDFDKDLKLKQNLNQLHVQKRDNKTVSTTTTTTTRNSNSASSTSGASGGNKSPSKKRKLVMDY

SEQ ID NO: 25147 - protein, 78 aa, Candida albicans
DQVVTLLNGPFPNRHIINRVAKWLSIPRNYNLEFSNTDSKVTIKIFFVLFGPNVGMIQWRSYLFILSSDTRPPKNSFV

SEQ ID NO: 25148 - protein, 68 aa, Candida albicans
AVSFPDSMLKPLNIFKEECSTMFYSKELTFNTKNIVLVPGRVFENIIDKKKMQTSISLFQFCCLTIPF

SEQ ID NO: 25149 - protein, 65 aa, Candida albicans
VTKLEHIPAFYVWYTIFYHGSELTLLDIVDDTTNETQKINSFVLFDDPTSNKIKNSQLIEDNMIY

SEQ ID NO: 25150 - protein, 157 aa, Candida albicans
AHKKKNTTQYRTNIVSPTPILVIIMSGIKISLKKKNPKLKKLIVNNSQQTDELSEQQKKLITSYSTEDKTTHKDETKPIIVLKQPCKSMLQKEIEIDEKPILPYGVTTFEKVETTKQSMIKKIESEDSDDDSSDDRKIPIDEFGAAFLRGLGCVHHG

SEQ ID NO: 25151 - protein, 117 aa, Candida albicans
TLPSIPGDLNLKINGISSTVIDDVILKEEALRGEVLTWDTESDGLMSTLNEWNSEGVISGAVALPRLVSINESECADSVSPSVLSKEVQNLFHAGPSLVESTAVEPLLVSLVSSCFI

SEQ ID NO: 25152 - protein, 93 aa, Candida albicans
IRTEIVDPIIIFSPPLFLNNDMLYEKRVLPPKRSYQRNPIVWAFFVLAILTIYKLPLTLFPQEQDVIDPKAVILNALETNLAGNWVFTTGLED

SEQ ID NO: 25153 - protein, 69 aa, Candida albicans
FIANLQGFNKFLLNDDKNKRMTVIYYFIYVNHNNMEFKMQRDFSKNQLLYSPFLLITIIKYQKNTRIET

SEQ ID NO: 25154 - protein, 72 aa, Candida albicans
QLYDQHPPGSGWIELNGTKTIHKIYTTVNEMQTSVVQVGQRVTTHYLLLKYLFCRLHSKSQFFRGFNISKFT

SEQ ID NO: 25155 - protein, 61 aa, Candida albicans
YFSHGRSDKRLSFSRGINSVIKSFRVVNRFRLPNIYGQYKDVLLCSSEYPSRDTYRLKSIY

SEQ ID NO: 25156 - protein, 155 aa, Candida albicans
TLRLPELSIRTNMQDIIDNQFLLLEFSYLDDEDDGDTGFTTVSHSTSRDSFFDIHGSDFTTSTSSQNNMGDKFKIANNLHSKSQKLAAVIQKWCFKKFYKKSKVKLNASKKILIISKKLDNSNDKFVYFDQSTELERTSNIATEQSKRDNGNVMT

SEQ ID NO: 25157 - protein, 63 aa, Candida albicans
RKNFSNIIEIPENKDSQSLKEVHQLYEKIGSIRKKSWQEKDQKITSVSSQITVLNKSRSYNIL

SEQ ID NO: 25158 - protein, 60 aa, Candida albicans
YANSPWLFVRSITPTFPKKTEIKPKNKIESLWSKHIRVKYWERSRGPWFKISNSLIWEGK

SEQ ID NO: 25159 - protein, 74 aa, Candida albicans
LFLNPGLESCLDKMGVMVVVEAVLLYNGTESNKEFMDDEELMNLKSAPEGLCGLELDSMSVDNGGNCLSLFRCI

SEQ ID NO: 25160 - protein, 64 aa, Candida albicans
KSGPSTPVVKTPLYIYPPRQIIKFQGFFFNLNNINQEFHNNQKLKPLPLPLQQLNTINFQDGLF

SEQ ID NO: 25161 - protein, 66 aa, Candida albicans
SNNRKDPADAVTDNRIIIILENPNVNLVFTNEYKLALGSLPPRAKEAYINITKYDMAIVFMSVFED

SEQ ID NO: 25162 - protein, 108 aa, Candida albicans
CEEYLLSRVGTYEKNIKVMYMYIHLTKLALTDCIYYHSMIGRCGIKVYPKKINGRDKSRTHDLSHAKGTRYQLRHTPVLTTAKFCAFCHCHLLEYIMTLLMLLNYFLQ

SEQ ID NO: 25163 - protein, 144 aa, Candida albicans
VHGFYFHFKVYACLLSNCVYCCCLLFVLFFVPMYMHICTFRIRRLLLARAWYLMSYASPTRHKLSSLFFFCSHRVKYTCSNILDTINIIIITHLKTKLKRKENGKDNDLHTYIYIYIDRYYAKKENVFVFVFVYVCFYDRTERK

SEQ ID NO: 25164 - protein, 107 aa, Candida albicans
LDYSHTHTPRMLWKLLRLFIIIKLIQLAIIYFSPCQFDTSSELIIQNLSSTSSSKSYYNVIITTILNKLIVWDSVYFNDLFINPIQFEHQFVFCPGWIQLIKLLNIK

SEQ ID NO: 25165 - protein, 62 aa, Candida albicans
IVLYENFPLMMGENDNVEEKSEDNDNNRVVRTKFVLLAKQEPQFSSSKVKSLQQAMVGQRSR

SEQ ID NO: 25166 - protein, 68 aa, Candida albicans
THKNYHRYNVHESTLVNSKTVSVIDRDRIFYLLQKNDRNDYCIIKSPEACSTGKCRLQIPSRELNHQR

SEQ ID NO: 25167 - protein, 64 aa, Candida albicans
  UNSURE (13),(18),(19),(20),(25),(29),(31),(35),(36): Identity of amino acid sequences at the above locations are unknown.
AWAAWCNHYTDLXASSLXXXGYRSXFMKXKXFFYXXNLKNKLNKNFYHFGLYQLQGYPSIINNS

SEQ ID NO: 25168 - protein, 97 aa, Candida albicans
  UNSURE (56): Identity of amino acid sequences at the above locations are unknown.
GKSNSIECPDEETTVMATIGNKRVAFSLASTSDSFSFDMNDKYTIKKEVYMAENTXSHQSVHTKYICSPLVMRAMKFTIVMYPMENAPMKTARDGST

SEQ ID NO: 25169 - protein, 76 aa, Candida albicans
NNYSNQTKRSSDTCFTKRDTTRQRVEYDQSKEWIHTHFLTQNIFHPVTKSTHAVSFASTDASNIHGQSARSGTCRR

SEQ ID NO: 25170 - protein, 83 aa, Candida albicans
NVYDNEQNNGRTTAASPTPMRIFHKEAGLITDKRGEKKHCPCMISCFYDFCTTRTNPLDHEETTSITSAYNGNFAVKQQRALI

SEQ ID NO: 25171 - protein, 84 aa, Candida albicans
  UNSURE (68),(75),(80),(81): Identity of amino acid sequences at the above locations are unknown.
NSHKISSKSFTHHIPKRSLIILLIPKHHTPNTTQHTTSHIHIPSSVSNTQTRTTPIGFSFILLSFFHXYLFLIVXSEREXXKRN

SEQ ID NO: 25172 - protein, 92 aa, Candida albicans
CNLFLGFVTLFLLQSFCYSTIPEGSGNKIDIYAQGGKETVTKGQNTQQQQRQSGQTHKRKKKKRKKKNYKTLTKYLLNHSHTTYPKDHSSYY

SEQ ID NO: 25173 - protein, 88 aa, Candida albicans
NGKQENRQRIKKKLKRMRYSHQRYTSQRLLPPTLPRLSPPAQRSPKKLNYLTTNAYFDSDLLRCGFFFFLTCLFVSPGLFISKIIVIN

SEQ ID NO: 25174 - protein, 60 aa, Candida albicans
IIYFPKGKGLFNTNMSRFGFNYMTIVSSKKKPQMLTYLDDTSGGQSMIVEPDLDQHVIIK

SEQ ID NO: 25175 - protein, 108 aa, Candida albicans
SQLSYVSVLIFIYLYGVVLNNFRFGISKLGELINKATGPTCFNIAREFLQPIPEALIMIKWDSFMEFLILILSLRITCNCLICVCVIFMWISKYPLSLVYHHFLIFLV

SEQ ID NO: 25176 - protein, 87 aa, Candida albicans
YTSESGYLLIHIKITHTHIRQLQVILSDNIKMRNSIKLSHLIMINASGIGCKNSRAILKQVGPVALFINSPNLEIPNLKLFKTTPYK

SEQ ID NO: 25177 - protein, 62 aa, Candida albicans
PIEYSARIVPPCLANSGYEWARAIKTPRKMKNHCPIRNDMTLEVHLYALDSRNVSNDMLYHE

SEQ ID NO: 25178 - protein, 84 aa, Candida albicans
QPQFYQDNNPHQLGKSTDIPTVIYTKSQQIGTPYGKVTNKEATGFERIGILQIKIPRRMHPIKIIATTAPNDMGSRIREKPTEI

SEQ ID NO: 25179 - protein, 64 aa, Candida albicans
NKHSEFYTMLQLAIDHVTPITTTLNVLQFRVSLINFALQIHPPPLKIIIYCTSFNLKSTIPLGG

SEQ ID NO: 25180 - protein, 119 aa, Candida albicans
TMNYLLRCTFTIGLLAYTALASPGDDLYAFQDCLYQCEQITCNNNPYHIIQQEFYTELSNNPDYEFRYYNPHWQFDPMPLPLHLRLLGWNCELNCDYQCQRIITGERIKNHEEIYQLPW

SEQ ID NO: 25181 - protein, 92 aa, Candida albicans
LIDIFLTNTHKEKFFFFLFLISFYSLLCDIPNLFKNRPNKQLDSLVYVLVGIVILCLWRKEFKVISGDEEPNTRGPEALQRLQLDILEDEEI

SEQ ID NO: 25182 - protein, 146 aa, Candida albicans
ELVKLNIINKLELFVVQSPHRNERSYNVELNYQNKTGQCSCEMSTIKECSCIDTLAVYCYINIYKNFYLEKIRGTPQNAIPLCLRIEMFPLVGQKIGTYAAEELLEELDEEGKLETSVSEIMNQLAASNEPLEGCLPISPLLSLAM

SEQ ID NO: 25183 - protein, 79 aa, Candida albicans
PFPFNRKELSVKDSLILIVIAFWKIVIILQNVITRIISVGIPTKNGGHQRMRITTNRLLSLATELFYTKRSKVSRMEVT

SEQ ID NO: 25184 - protein, 274 aa, Candida albicans
LSIQTKLKLTKETQEIAMLVRRVIVKHTIKPKCHNLVPAFHVASGVISYGNCHGPPKLFQRLDSQLYIRTLSTSSNDNFEIDFVTMKKKPKKLSESDKQQYVSIHKLELPKVDFDNIHFKHSALDEWLFQLFKENQFSASEDSLSNNRLKENLGIIHEIYSELREFEIFVQFKRNKKHFKFSELSTSDILKYLEEFKEVHNGSSQSYHKMYDELSRLLKSDSEFSQTLSYELILAIQLLENYSLIITVDYLCLNRSYGPWTNNMISKNLDPPRI

SEQ ID NO: 25185 - protein, 66 aa, Candida albicans
LILIKEGMSRVLFVFVLYHSAKFDLNPLFLSLRAHMVTIEKDRYINYYHYNCLIKVPQVGLLFFSY

SEQ ID NO: 25186 - protein, 409 aa, Candida albicans
  UNSURE (400): Identity of amino acid sequences at the above locations are unknown.
KITIKIKTKQTTLQNINKRTIHPLFSYFIIIMNGLVDLNNKSLSQPATPPRSSPNTTIDHSQSLPNSILRGSRRTSIYNIPLPPHGLSEATTFLSQQLQHQLSERGRSRSRHSTHNTTSNHGSVTPKLRRSVTPNSRMSLTPIRSRRNSRRRSSIIITKTGEKLYEPNYQGPITIDYLKFFCKTLIQNQDKINQQQQQQRQQQLGEPFVDTRDLVTSEERNDSRISETSKHVTQESTNVVSPFEKNESNSPLQIQEEFSQSLIIPSNNDNILESLDETKQDVNDVVLQEQHSHIDEMPQHDKDSPEKRKPLSYLQKILLAKSKKSSLISRKTSDETPTKEVVPKLDDLKQSEENDALTVDTGKQDSQFEQDNGEIIDKIDHFAIQDNSKISNSILPDWRXCNTPLEDAE

SEQ ID NO: 25187 - protein, 71 aa, Candida albicans
NTLKDLPNGDRNLVQTGQSTAVVVMVIDAVSNTAIKYSSGLWYVYDFLGIYLFCYKKIVFVYFFNIFIYSI

SEQ ID NO: 25188 - protein, 204 aa, Candida albicans
LVELTEFSKSREHLNFSKIMLPEPSKTEVSNESNSSQVAKAKVEKPNPKNILSVELTSHLGEDISQSKFKFAFEKSISAAIRQTYASKFPQFAQSPTASSIYDKYDVFDEILSAPVTKNRFEVFDIKYKFYGEESSKNKVSADSFDELLGLLTPVQYLETGSSNVNVLFKIKFDDKLQDSKLFVENFENSLLSQIPANKLKITN

SEQ ID NO: 25189 - protein, 345 aa, Candida albicans
VYKSRMHPYQASGGNNNLSSGNASTNIPQVTSPTQSNLRQGYLQQVPTQNITNNSYYPRNTSSNVAPNLLPHLSYNGILPPRTFIGTSPLNGIPPPAYGSQPKQYQQAQPSNQRLSFRNDQPQQLDPKQLQKITSPYQQTSQQSLSPPPPQQQQQQQSYYQQSLQNYSRESSQHPQGQQTRGLLSSGNSSNQINLSASIQQDDHRQHKSNNHKKTNESNVVAKPIDQIDPSTGKKKRGRPKKFILDPSTNTMIDSTHPNFKQLNKALKDGNIDQDVRSNGNNVTNDMSVLLNSSGTVDGFNDSELKELLKKKDRRGRPRKFPVEETGVTIKGVRINGSGISKTKN

SEQ ID NO: 25190 - protein, 176 aa, Candida albicans
THSVGPSARAGEEKSVIKVIEENGDPKEFIIECSDSEAESQLTQEMYYNPVTKQLETSPPTSSSSMITGDEESIVTNKPEVITTRGLQFDPNAPVVVISTWMDLIKRVQIMKMLFAPIDIIGEFIPGLQGLVVIIELLLFIWILYEMSRLVNAICMMITAVCAPMIAVGKFMNRIV

SEQ ID NO: 25191 - protein, 61 aa, Candida albicans
KRGGQKDIEGREIRVYSFEEPKELSSVCSKLEHPILMRPMGEISIKFPPPQRTLVIRYNQL

SEQ ID NO: 25192 - protein, 60 aa, Candida albicans
RGFPLNWWLFMEGSPGNKYYSLAAKPKSNNNINNNAINNTSYQLKYEKGNRILKFIIMFS

SEQ ID NO: 25193 - protein, 62 aa, Candida albicans
LKALSFDLVLMNHLKHPKHNQLTHFNHLIKIELTILFWDFATIPGFNNNWLMAWVTIIGYNE

SEQ ID NO: 25194 - protein, 62 aa, Candida albicans
AKSAVYHMTFLGTHPTLTQVPPNFLKFDSINNTLAPYLAVVFAEATPPDPYSATRAGRSASY

SEQ ID NO: 25195 - protein, 82 aa, Candida albicans
VEIIRKSAKRYMSSSKRMPNLYITSISKDAIYMVVRSESILLWAEQSTKKKIHTQETTHLEKNSFQQQPLDQINHRCQQVFQ

SEQ ID NO: 25196 - protein, 70 aa, Candida albicans
IVCIYLYYRFYTVVWNNVLFTPLNTIVFIILTGSTLPPHYLKAARYFTKTKKNRGQAKKKTVSSLIFNSF

SEQ ID NO: 25197 - protein, 111 aa, Candida albicans
SRFLLNSFYKSKERKTLANWFSLTFHYHSFQLYTLPLVFNHLFILVSQQYSLISCIHIPKSKHSFFLICIPIVLVVISVKIIEINLESSNSNNNYIIPEEKRQREFIVVSI

SEQ ID NO: 25198 - protein, 69 aa, Candida albicans
SMLCQKSNQNQTAKELCCLFIFFDYEYTKKFKLELELVLVSLLVLIRLYCKVYVRVWMLLKRKKQMFQV

SEQ ID NO: 25199 - protein, 60 aa, Candida albicans
NEDNVKQECLVGSRKFFSFFMENFFVSMGKQKQKQKHLKQKTSRGNRELKNNKIVIPNLN

SEQ ID NO: 25200 - protein, 83 aa, Candida albicans
AGKNSSPPLALCSEKNLAADFGCNNPDIVDDDIGGSGVLIGWACSIKYSSLKATWFDVVAVAAVPVGTPRLGGINSVASKNES

SEQ ID NO: 25201 - protein, 77 aa, Candida albicans
  UNSURE (47),(51): Identity of amino acid sequences at the above locations are unknown.
VLYHLSTKCTIPLSAIHFQNSFFPRTSNPHQLHPLKSSGTPNSSKCXCSSXDYHPIPLSLEESPFTNLIFPKWFPRL

SEQ ID NO: 25202 - protein, 78 aa, Candida albicans
AFCGVPSINECCYQISGTTPEAKSIHWVCDQSRDTKSAGKVKEEPYAPTILGNVVYCVDFSFRLQEICQYIYTFGFAY

SEQ ID NO: 25203 - protein, 74 aa, Candida albicans
RPEKCVYISRKFLDNANKKHLPLNLPPPKNNRVQLSSQQFVFYCFNKQNQKYKYIDKFPVDEKKNLHSIQHYPR

SEQ ID NO: 25204 - protein, 67 aa, Candida albicans
PKMIFLESVGAFHMNKILSDHIFKPEDWETSFSSTGIGSSMTEEDPDPDTTQDFANNVKEESVSEEE

SEQ ID NO: 25205 - protein, 64 aa, Candida albicans
IAQPLQKGKKNVNIGTLKVKRKIHIKHTLFGVRSTSNNSCNAFLILFTVISSKLATLKMAYFNG

SEQ ID NO: 25206 - protein, 72 aa, Candida albicans
YPFLRKVDAAAQFYIDQQKPTCTRCTQIYEFLKMVIISVLSILRCVLHGYINKEYRQAVVKMFHVTLYDFGF

SEQ ID NO: 25207 - protein, 63 aa, Candida albicans
MIVLKVVTTIIVAVVVMILYLENLTIKTIMALIMMYRKYIYTYINILLETNINKFYITLCTRI

SEQ ID NO: 25208 - protein, 64 aa, Candida albicans
IGQSVTIRNGDQRLVYEGGYLNTIDYLSESNQQSVYPPLLLHQGNEKIYSSDNGIKVLLLIVVI

SEQ ID NO: 25209 - protein, 90 aa, Candida albicans
CNEVWYNNKQQTPGPRVVSNEEQKWYEQNLSEANRGKLFSSFIWPNKVKKERDHNCVKSTTITTTTSSTQLNNLFSTLGHNSHNPHSFKF

SEQ ID NO: 25210 - protein, 63 aa, Candida albicans
QIKHRKQVYHLIMQLNNSRLIYFDEIIAVVTLPSKVSSSCTQTNYKLNPIFPLNSYLYFFCSY

SEQ ID NO: 25211 - protein, 174 aa, Candida albicans
ITMQFSTLVSLAAVIVSTNAAALLTQTVESSTVVTITSCGPEHTNCPASSPATPAPAPSASAPAPPAPEQPEPSAPAPAPSAPAPEQPEQPATPATPAAPATPATPAAPEPSAPAPEQPASPATPEQPAAPATPATPAAPEPSAPAPEQPASPAAPAPAPSAPSSYRREVNYPG

SEQ ID NO: 25212 - protein, 76 aa, Candida albicans
TFLSRTVEEKKIKGGGWVGGPAAALVKIILSGDALKLANELELKHFTVNKTRECLPIYTFEGKRKAYIPAPIEYRE

SEQ ID NO: 25213 - protein, 61 aa, Candida albicans
FSIVISFHMQKVYFYKLFYWHIANDHGDSGGDDNGCRRFSHAQWKKKKLKGEDGWGDQLQP

SEQ ID NO: 25214 - protein, 73 aa, Candida albicans
LTNLFFIFWLTWIFFFFLFFNHLVKYHLPTYLPFKRAPPKITPPSSKKNESLRHESIIYNRYTIFLFNIIFYS

SEQ ID NO: 25215 - protein, 561 aa, Candida albicans
EGFINDLNFTLNPSPPPRIMRFEYNPVIIRYQNKTETFASSGIHLVIKPEKSSKNANDLNSIIDEFFLTINHLPDLSKFQILISENYILGTDQIPDQVIWHRGKLDKVYNLPFDKISGFNVFPFDSFNHTSSSSSSQQQKVSLIKIRCINIDISNITTMSQFDIDEGTNVGDEINIICQPFILTNSFLFKKFKCQSNIIGKLFTKDTTIVKNFHYYWLSDLKYLDDIHGGIVMTKPNEKIIGLVFGNLRKLNGDGDLTIIVPIEKVVELIGLPIPTNSHKPSLSTSLAYSSVTPPTTISSSLESSGDYVIPLLITDSRGNNTWGSSVLFQNNVLITNQHVIQPYMDDINNGQCVVKPQTTSLFTLGKKDKIIIPISGIDLAFIFLDKPITSKSRLVKICHQYNQGDAVYSSSYGLIYTGTSDNIQEEPIKSNGIINQIIKLSIQQNLKQVMNCMLISSSNCWNGSSGGGLFKQQTNEFIGLICSNANVKLPLPFNNNGKGKVDRFEKVPSFSFILPIQIIEYCYYMILCNQDTTQINLEGLINLWNLKSLHQDILLESSKL

SEQ ID NO: 25216 - protein, 275 aa, Candida albicans
HLFHGSFTFHYRTSTLNEIDISMDPPRYNQVLDFIAILEQSDPAAFQSYNYSTQKEYPSIQRDKITDINSKGLPTIADVVAHLKLLKAFGALKAKVLGTSKVIKDLEPAQHKYWQVFLTNAVRRFIIFVSALRKYSCDTVSTVVREDTFFKVIKNKKFESMMSQIMPPLDVIMVWHAFLLNPKTFYDSFTRTDFIVFAKYPLPLDRIHGCIDNTTFEFNVPEIYRENYSSLLQSFTNDPNDLIFDPIDDLLAVRITDKQVNIYFLHLGYGRAALY

SEQ ID NO: 25217 - protein, 61 aa, Candida albicans
YQLGKSSLKIFFPEIRPLNTNNGGNIKGTHEKFATSITVHCISNLLENLNIPSKVLPYAWG

SEQ ID NO: 25218 - protein, 194 aa, Candida albicans
NQNWGDQQPFGFVPTPPQQQPYGSVPPPPPQSSSSRPPQSYGQPYYGNQQPTYGSPVQQPAMNQWNSPPQPPQNPAANLLQGLNPAQIQSMIQLLQSQQQGGHPPQGNYGQPQRPAPNSYGGMGYNNNNNYGSNAPSMAPQPQGTNDNSANQVQALLAQLQSNQQGNSYGQPSSQNQQGQGSSFYDTLSRLAKQ

SEQ ID NO: 25219 - protein, 109 aa, Candida albicans
  UNSURE (30),(33),(66): Identity of amino acid sequences at the above locations are unknown.
IIHIYIYIITNHRNIMTAADTHSIISADVXEHXRHIIRPPKFTWPAIRKYAITRVTSLWVGWDELXQYSWHEVLNPFEPLVEMNLHQWNFFFLGFGHGLGMLWIFLLLH

SEQ ID NO: 25220 - protein, 151 aa, Candida albicans
IPLYILDFLFYIKHIFLKTTSIKTNHNFNKISSIFILLNLDIPWLNNIMIIVLTMEFLVLAIIGATYASVLFEPLAQSVRNMRRVNYRSTYTNVNSFKRKIKRSSKIKLARPKVKNRKNRMQWQPEQTISYPGLAFNIDPRNKYLLGVLPH

SEQ ID NO: 25221 - protein, 61 aa, Candida albicans
APSMVLRPACGRFNSKGLGDIDIDNLLTNRHKNGYDVNKLHQLRFLRDKKTRLQYSLNRLN

SEQ ID NO: 25222 - protein, 116 aa, Candida albicans
STQRCILKTEGERTERNIQLIFNVFILYEMYMLLLLLSLYNCESKSKSKLKLKSKCCKNYIVPLTKYIVSPVLKTVDFKDVDINFGSPSTPLLPLLSSNLKIFNFSSDSLVTLFLF

SEQ ID NO: 25223 - protein, 61 aa, Candida albicans
TFCFILTITKMKDGSNMMIITQMGIQPNNTMGLLIIYIIYTSLSNSNLIQNFLLHFPIQNF

SEQ ID NO: 25224 - protein, 91 aa, Candida albicans
NIKPLQSNMAKYYQCRLVLGSDYSARVFLALLVECKVSNFDIQVLSSFTLQTTIKTIHGSLISLQRGYLYKFSNHSLSTTCSVLSLKGETL

SEQ ID NO: 25225 - protein, 67 aa, Candida albicans
KYHFTHNKNISQCKEKKRIKTYTQKKLYAIATFEYNYFLSQSSYINNVFGFWFINIWVRIWIIRISK

SEQ ID NO: 25226 - protein, 179 aa, Candida albicans
SSCHCSIYFVERILVDFYKLWIKYSSDFQSVYGCKLQVLASMSILNNDNAVNLIPEDLIGETVDLLLSNIATLPSAIKAKNAILSSESSQKTQQKVMEDNGEDEGEEFADFEDDFEVDEAELEAMKETPIDQLNAFEYFAQNLLSLQQQQNKYDVLFGGIDSNKKEMIQELIKITQQTR

SEQ ID NO: 25227 - protein, 81 aa, Candida albicans
LDIISRKPISLFVIFISEVIIIRLKKNMDRLNLIFPRPEILSVRISSPTGITKGDWKLAFTFSSLYTFILIFMILLMGLFV

SEQ ID NO: 25228 - protein, 88 aa, Candida albicans
VWVVVLGGSNYFGREELLVYLGGGQRKTDNTLNRERKEEKKIQMGEEEKEEEGGGEREENERKKSIKVKEQNGEREKFNQTNKTNKQE

SEQ ID NO: 25229 - protein, 66 aa, Candida albicans
  UNSURE (47),(48): Identity of amino acid sequences at the above locations are unknown.
SYNQSVNDDNISYIYIYISMGRLYCLEVMYYEWKGRGGEEGEWCVAXXDGRPTFLQPSPYKSKQTG

SEQ ID NO: 25230 - protein, 74 aa, Candida albicans
LAINQLIQLIPYQLIIRLGSKEKKGKAKELDCVLLKRDYFDLVDITHDLCTVLKIKFHLNKEKKKSITKTKKRW

SEQ ID NO: 25231 - protein, 79 aa, Candida albicans
SDLVTFGLFRYNGVIGGSSSGVCTGRITGSSPIRFMDLGGDDNQNRDGELPSDIGARFGESGVGCCCIGMNLDVENECV

SEQ ID NO: 25232 - protein, 194 aa, Candida albicans
VMSSSPKDILPLTHRPFGDENQHYVDHPEPELLATSVGKEVDGRLIPSSSTISLLSLNQSPSLRNSTTTSYTNLQHLQRMQPYHNQKVTTSPADYTHSFSTSRFIPIQQQPTPDSPNLAPISLGSSPSRFWLSSPPKSMNRIGDEPVIRPVQTPLEEPPMTPLYLNRPNVTRSDYFSRVSTVSEEEERRSMGHK

SEQ ID NO: 25233 - protein, 79 aa, Candida albicans
MRLRRNINIENAHDVDLETSISYSLVIAIFSSLRIPSKLYTSTYIIAKCSQSCWLYFKSDMKECNLRKKKVYFEDHQYY

SEQ ID NO: 25234 - protein, 76 aa, Candida albicans
SNVDPVFGWCYGFIRFSWQTAKDSLVKNNAAEVVYEDQGKGVEKGYQDVFAMIDKKKDNSKLKRNYFCSSSNVNLL

SEQ ID NO: 25235 - protein, 174 aa, Candida albicans
LIVSDCLANNDSEWDNSIVDDNSISRALTVDEIKDSAITDDISGCGSVDGWTESVLTAGSEMLIIIDSLGVTNVGSAEEDTFEICVSLGKYELDDISEDEVEVETAPTLVDNSGIDDSLTIIESLGVTIEKEDALGSCVSLTNNESEVNESTTTDDSVTCVSMVVDDEVIAEDS

SEQ ID NO: 25236 - protein, 67 aa, Candida albicans
LKKKDVKKKWLKELKVDIPSVSWKKLQELLPKRNKSLEDVDVEHKYSLKVCTSILIVYVHRILSSFL

SEQ ID NO: 25237 - protein, 83 aa, Candida albicans
FVVTFSFPFLSHLSNNFKSVNPLYDFFIAISFRVWSATFPVYVSLSPLVKFPHLKLMYLPLTIFPISNQFSPKKSGPHGLKSG

SEQ ID NO: 25238 - protein, 67 aa, Candida albicans
SDSKYFCIFMSSNSLTSLISSSLVLFESFLPPIIEPKSSLNASDIPGRGFLDSLSKNDSLSSSEYPR

SEQ ID NO: 25239 - protein, 78 aa, Candida albicans
NENKNYTNTLSLHIKQHSNLITYKQLLAYFLQHEPSSKANLEDLSTFKVQVSTPLAPALTSEVVLAYDGFTSKTGFSV

SEQ ID NO: 25240 - protein, 88 aa, Candida albicans
FEYILVSPIRKNLPPYVLLCTSSVISVKRQYQKLIAWIFFFRFFFFQDKTFKMPSTKLLQRKTNKIYYEMKTKIIRILSHYISNNTVI

SEQ ID NO: 25241 - protein, 167 aa, Candida albicans
INQLKTASMSTQTDILITYQLTSNSIESLKSVDESEYWKRKLIELLLTRSIHIFPNDENSTQIVYDQISNNRISIFGQKDHPGKRGILSKSYTISGSVLLTINPLAAYYHDRAKQPEFIVKFEKVLQPYITTYTKTLNQYEKGLTYLIIRVFLAYLVFTTGWKVRDC

SEQ ID NO: 25242 - protein, 62 aa, Candida albicans
IGYGIPDPALKKWVSKLNLEMPLLKVSSLIVETDVDAAAPVGARDPVLVPGFALVVVPDLGQ

SEQ ID NO: 25243 - protein, 100 aa, Candida albicans
MKLQKLNKKRSSGSNTIITITINDNGNNSKSINRNGKASKKNNYHYKMFYRSIDGYRREIVKDEKKKKKGFSFSVNQQNSKSMFVCIHNNTKKQMMKIEK

SEQ ID NO: 25244 - protein, 199 aa, Candida albicans
IGHIRRARILPASVGEDITTPGSAIYRNPDSVLQALASLIDSRIPLTGLVTDDQQVSGSSSDSNPSTNSYGSMDIVSNTKVADKGRIAGITIGAAAGCGLYMTLMVLLFRKFRKSNKALELPITDSESNLGFSDEDSSMLESSSGFSAIFSRINHGGVLTGDPNGGGDDMMMMNNNNNNLRPNNISEPVQASNSLGWYH

SEQ ID NO: 25245 - protein, 68 aa, Candida albicans
LYFKYFIGFNVTHYRRELIIIIYVLDPFETGNDNKRIMNILIIIYIYNFTHTYIYLRHGFCIVLRIIF

SEQ ID NO: 25246 - protein, 463 aa, Candida albicans
  UNSURE (17),(29),(31),(85): Identity of amino acid sequences at the above locations are unknown.
ETFNWYHFIFRYDTLHXKMSSRNGFLLSXWXRLIVLNRGISHHYTCIRWNHLSSDSQQTRQQVPISPEISGEIDAIGKKSTEKSXEGLSYDLSQLLDEDTLVGKQKDQNQSSEQLPIGSMMESSSDSEPMDFQQLSNFIKEAYEKNPNYKEMERSPSAKRRQVDYFEALFSKYGGTLDRGKKTKTKSSVSDSELDRISSLKEKLRGELTSRCTVALEPTLTHFRTYKTSHELFQTAQTILNNFAKKLQNVGKKTRKTNTSETDSVKLTQIREEIFVQHLFRPIDKNSWLDVHEEYVNNVETQSRLSPENPICDVITLPIIFNEIIDCLAFKFNQGQLAMSLFDLIEKDFSFHTIAVNQDTYNLILRLVWVYYGNTNLDQFYRRYHRMTSLGFTGDVKTLNILKTVYNEYDRLKNGKLIFNNSNSPIYTPEDNIRMEYFEKEYNKLKRRLEHGVQHKDFMLNNY

SEQ ID NO: 25247 - protein, 66 aa, Candida albicans
LYNWCICRIIQVGIILLVILNQICIIKLSELRHFKYDYKCVFELSNCVKNKCHSQWYLLFSKASSG

SEQ ID NO: 25248 - protein, 123 aa, Candida albicans
RKKKTLCPHTFSQRLNSTSGMTNQHLRDSQMGFLQRCSEFFLIVQDFLHDRVRRDIVNGVLTSDTHKNYQFDPELKRVCEIKSSSQYGETRKLYRLTWVCIRCFKKKYHIYGVNTVLILQILT

SEQ ID NO: 25249 - protein, 75 aa, Candida albicans
YRKSTAAGGTGAFQCVSRVKLPPAKKIPTKISERRDSLNIIFFSILFSFNSSFNIYLSVLANSTLYHSYSSCQNI

SEQ ID NO: 25250 - protein, 63 aa, Candida albicans
QKHTKTTLQNKKKTCRKEEIEEEDVGTGGSGGGRSGRSGSRGRGGGRRTPSGANRGRTPTARQ

SEQ ID NO: 25251 - protein, 103 aa, Candida albicans
KKKMLAPVAVVVAEVEEVALEEEVVEEELHLVPIVVEHPLRGNKNRSPRTITQYGDLMDDDNIFIPKTMSEVASNMGRKKYGGMSEEIDYTGSHQEDFMPDTI

SEQ ID NO: 25252 - protein, 77 aa, Candida albicans
MSTQSIPLVTPYDYHDDDVDKKYRSKGFFEMFYSLRTLIISIVIGIITLFTIYTQISNSKSGYAPNLSTFDTSQVQF

SEQ ID NO: 25253 - protein, 69 aa, Candida albicans
YPPRNNPIFYGFSIYTRRASDYPFVFLNLVNKHTTLIIWWRERLPALHYLRVCLYFVLFSVITLLPLHT

SEQ ID NO: 25254 - protein, 106 aa, Candida albicans
EEKKKFVCVCVIISRDFDLVVCVPIYEILLSLDEPIHTTHTTQHTHNKMHTHIHNRLKKKKVTIILFLFMKFLYLKTNYGNKYCFEQLSLYEAVMNVNLLVFVMNF

SEQ ID NO: 25255 - protein, 64 aa, Candida albicans
IYNNTCVYVPLCVCAQNYTKLFFKLDDDKYVNKMSRQSGTPRDPLFIHCIDRIHTNVKVYIYPS

SEQ ID NO: 25256 - protein, 72 aa, Candida albicans
SYCTPLFFFQIITPPPRLLTYSTDNFLCLDFFFRLFFFQQLNYNNGSTQLILNNALYRPRSLSTTRRSGLTC

SEQ ID NO: 25257 - protein, 84 aa, Candida albicans
HKRYCGFLVFCYLFFFSDGVDKKKTMIVGNKPFNKCDNSGLCVEYVISIIYYLSRIKIGLIYSNYDNKSVPIPPLKGARCLFFF

SEQ ID NO: 25258 - protein, 73 aa, Candida albicans
KKKKKLINYQSVSNSLRTVPSERGSKNALFFFSLFSRKYFLICFPSVHLSESSIVIKGNSYSETIYKRKGYND

SEQ ID NO: 25259 - protein, 185 aa, Candida albicans
  UNSURE (1): Identity of amino acid sequences at the above locations are unknown.
XIGSFTISVPSYVHYKNILVNLINVWNFTYDTPSANGKNQQIYDYHQWKTHKNDILIEIPTTLRRGLHQQSYNFPFPIFYYHDELTAIINVFHRLALLFLHEGLTKRVSRKDRLKEDMMFPLNFAYIVSLEIVGTLKPYENSPFISSIGLFALKYIWKYLQNDSNLTPLLQNMVSDLSLLSKIRT

SEQ ID NO: 25260 - protein, 75 aa, Candida albicans
RQGLWNLILISEPVEIEYDVLKLCPYYFQSKKRFIPHSSYTISHLIYFNLLNNLGATQSFTQCCKWKNSSIQSSL

SEQ ID NO: 25261 - protein, 140 aa, Candida albicans
TSMGIIPCGKNFRESPQPPETATINSEAEMTNKQDSTYSKSILPQPQPQPQPVQSITNYPPASAPVQPQPFQHAQPQRLPSFHQLPQIAFKTSMFGKDNEKSTLPSLSKSLHPSSLSSQVHHHRKTIKLLRQFTSKINQS

SEQ ID NO: 25262 - protein, 91 aa, Candida albicans
GYLTKMLIDRSLPLLIKKVEFKPSIWSFGVARVHYWILNNTQFDRDEVCYGGEYKIGHVNKYTFIEIYTLTTYFSPLAPIFSKSFRALSMM

SEQ ID NO: 25263 - protein, 521 aa, Candida albicans
ITIWPSAVENSLYDHILALSSTCTYFRKRLAPILFQSLSLVRTNQVDAVLESPKSQQLFSDTKTIQQHFMKELIVNNIEQCERAATTWTSFQTNTFDDKMFKSRYGKYLMMTRFVNYLECDNSFLNGEGIRLFSNLTALKVLDIGEGAVFMSNFELANLRYLAINAQTLIYSPQFLRIVPKLNRLDLFLDYGNLPSLVGIRPLIQQFRTFSQLTELVLLLNNPFTIAYLDTIKLLETISKNASNFAKLTIRYIRRNNESTVDQSGWELYQGRIGGKLLKVFKNLTDLIIDISILDLIKFDPETYSSPVLYTDHLMEKRITLVDEVVVGPNIDSTTREIAGVIIRHCQFTHLFFQYGESIEESHLHVLKLLTDFVGWLSNGHLDQSRNYLGIRQISLEKCWSMTDDSLLRDMIGSSIKSKSESDLSALQKVYPWTTTINNSPRYKDIDSYNINYVEEAGLSITDSRGYFIGVSDQDADRPQFTIVDKKSGIQTINMEFWSGESSLLDFEQYSIRQRRSLLWG

SEQ ID NO: 25264 - protein, 150 aa, Candida albicans
NTENALELIITYLQNVVNNNSYIEVDETDAAIVCSLLVIVLFTNYNWINETFTEKDIPKYVQEELEIFLNRYQKNWDENYKNKQIEIKIKIGEQKEVVSIPKLANLSLKQVLNPKISESCELWVETEYYDEWKQRIQILVDKLEQIQTSQ

SEQ ID NO: 25265 - protein, 64 aa, Candida albicans
ILNPPLFFLYTYNKFDTINILHSFFNSSFFPFQKYHLNFLKIIYGCLGLLVILIVICPVNVGLN

SEQ ID NO: 25266 - protein, 64 aa, Candida albicans
KSSEGYINKERKQESILFLYKKKIQEESLRDSYSTVAKSGLSDFGDVDSSSSELLGFGFFQMAK

SEQ ID NO: 25267 - protein, 61 aa, Candida albicans
TMVEYKIYRNENRDIYYLIRKMSHEIFIILTIVCCSLVFCVVKKCGGGKRKRKREGGGKWW

SEQ ID NO: 25268 - protein, 98 aa, Candida albicans
  UNSURE (68),(85),(93): Identity of amino acid sequences at the above locations are unknown.
GVCICVYINMFFLELTLHLYNQIDYHEIIMQQLKGCKINQNFIHKVYLFQRFDNNNTVYFSSLSENYXFFPNNTNPPILKKNGWXKKIPEILXPCWVC

SEQ ID NO: 25269 - protein, 65 aa, Candida albicans
IYKYFRNWNDKLYIYISIENDNKQQSMKERKEDFFVVCLRKAKKNCKEFSFSFFCLSFSLSLSLC

SEQ ID NO: 25270 - protein, 302 aa, Candida albicans
VSPLFFIATTTTTITAMTLSIYDLGEDILTSQISNYLSPEDIFKFFSLSKTLYSIYQNSSIIYQYLYNKKFTNNENNYTLSLQENLNWKQLFYLRCNRHQKVYTWGQSLMGRLGYNLSQVPIENRSENFGWMMVHTPTNINNFNDHIIVDIVATGFSFIILANDGELFFTGNDWKQSHNRATPGPIKTQDYRPTPGTMALYTLTNNQTLEPIISRRNIVRGVPPMPMMNRRYANDDSDDSSGENSDGEIITPDATTTTESTSISVPPLVPAPTSSALPQGKKGNYSTRNNTNINTSIDLSSF

SEQ ID NO: 25271 - protein, 291 aa, Candida albicans
YKYKELQSLMSIILSVVPYFTIVLGLGIWAYKLIYHNNLIQKYSTYLYIPKVHINDYIDKNLKHLNLIRVNIDSHDDLHEEKPSVLYNSKSDMLNRIIGIVFSVTLSLSVGLILLILLELGDFLDADSRLGLFKITINTLIFLLVSVVPIFIISLLAIQDILPKTLPSAGLVSILYAVWLLVLHKCGDLTQSFNPRGDVSRHVVEKVINEVSIVGITILAILSGVGSISTPYKIFEKYKGLEPDSKDVNQADINSNIHYFKNTIIIDCPAGIQNSINCKLQQGETVYYLPK

SEQ ID NO: 25272 - protein, 60 aa, Candida albicans
HDRSIGEWYTFVSTIHIIEARNIMHYDVELKKPKLHDGSFRYQLSHSYPHCSLKSNCLYN

SEQ ID NO: 25273 - protein, 67 aa, Candida albicans
FYIHWYNIMLFLDGMRDYNWVDLRSKVIQTSSNLVLRYSLCTKHKNTNTNNFFVYHTQRVDGIFYYQ

SEQ ID NO: 25274 - protein, 65 aa, Candida albicans
EQYSFMTNKEPIIKSIIGHRDYGPGGYYLEIEFENSKTGWMLIANVKLRKPDLFKKYVKNNPEVK

SEQ ID NO: 25275 - protein, 113 aa, Candida albicans
  UNSURE (60): Identity of amino acid sequences at the above locations are unknown.
IKNSTQNFIIESNKILQTYESVCVCVSVGGGGGSNNQKKNNKIGMMMGGKTNDYNWKGVXKNWGCFTIQLEINKISGGTFTTYLCLWKMVFEIVTTNGLIIYITMVMTPGILE

SEQ ID NO: 25276 - protein, 215 aa, Candida albicans
LKLHSSTFEPIPTFLRSRVRRDLVGRIDLSAKIDKEDKQFLMQKMSSLQSFLKLDFNTTELICIAYGSTNMELKLKNNIMETDTLRKLGKTRFKMSLFKNTIFIDDRYLTATPMELSSDLDIFNNEEVIYEFLKLNQLHRHSLLNRELLINTKLPRKDYVTKRQMLWKQAAIGSFYTMLGIVMVKYRDEKLLDKLIIDKIINGKRGVIKIVQRNL

SEQ ID NO: 25277 - protein, 62 aa, Candida albicans
PFRIFNLQQTFSFKMKKYVVPIGLITFDENKAQTTNIYLIFLLDYKRLKSKRRWFISIQRCK

SEQ ID NO: 25278 - protein, 142 aa, Candida albicans
CTVYLDIKVFPAIFMRDIATLLDVINTIFIGWSISVVININPTSRSPTELQFLNTENLPFLLILISNCFLKSIWSYKPGGISLNFEKEKDSVTVRKIACVLTAGGLGFVIGMITQNFILKSFSSVVTISFTLSCFTITLLLK

SEQ ID NO: 25279 - protein, 83 aa, Candida albicans
VHLPHRMAMADAFIDIFLTVFFINNFNYSILSLSVSLVNCVNIKLSRYNRRKVVVQSWLNKSKIFGDTNAATNLTHFVLCTIC

SEQ ID NO: 25280 - protein, 79 aa, Candida albicans
LIRMHDKGNYFKFETREASDDKRLFVKYSFGNEIANSVTRTLFYDIESNYNNKYSKFFEEIEKRSCQNFPFLLARYGII

SEQ ID NO: 25281 - protein, 65 aa, Candida albicans
HTETANQMKLKSNRRKRATLPKKKEMIRRMKVQAKNPSLWRIHEHKQSHIVQMVPLSVLPITKIF

SEQ ID NO: 25282 - protein, 61 aa, Candida albicans
VMKEMLRWKVLIMKHFLIQEIYCENQKLLDCALFSTRVLIKFIVKMSNHSHGIGYLTDILN

SEQ ID NO: 25283 - protein, 61 aa, Candida albicans
DTWMHLPLNLGYLESCQKKIINSVKWYLEINRKKKETKEGWNLYDVSLIRARLTTFFSFKC

SEQ ID NO: 25284 - protein, 86 aa, Candida albicans
FVKVSTNNLILDLYYFTTTSVEGLKLKKDIHLTSFNKCTYTLQLYITIYIFAWSGDGSCTRTVYSCRWCSSCFFGNRFSSVFSSRP

SEQ ID NO: 25285 - protein, 61 aa, Candida albicans
KLSQIIVQYKEAGYLKCRFRRQWFKGKILASQARAPGSSPGWRSHELFFSENNSNLLDINL

SEQ ID NO: 25286 - protein, 77 aa, Candida albicans
SLFINLSYFLFKIYNLYFSALLYSCSDVFLKINLFLIISYRTYIWDLYKTIYTTYDWKNGNQIDNTRLLQQQYIVYT

SEQ ID NO: 25287 - protein, 107 aa, Candida albicans
PDLPAPCVNTSNGNYIYKDRNGISQLELDWNKEYHVGFEWLPDIDDQGGKSEWGHWFNLRKSNCQQERLVPVINSEFKVPQYLAFTNNCLTKLNHSKTTPCCNHHNN

SEQ ID NO: 25288 - protein, 86 aa, Candida albicans
HFGSSSRLGKIHQQQKNSITNLHQPIQIHLSNVDTTAHTIIHYLTTKYSQLVSETARPPSERSYKYSISLDTDQIIQSKPYFLTHQ

SEQ ID NO: 25289 - protein, 75 aa, Candida albicans
FITITITTTTTTTTTTTTTTKNINLLLLVYTYTYTQIKKTLMAGAGGREGGGLLDPFSFSILDFEFFTFRMNTIK

SEQ ID NO: 25290 - protein, 202 aa, Candida albicans
GPATNFFYFFFTAIDFSFLITNTDLAKQMFRSIIQSRRQLVQLRNLSKYARNPQIFIHEDTLTPQLYKFSLSKSPLALHMGTSLSLNPTAANFKANNEFIKLLDSTLHDSIHDDFTYIMEASTHASSFMPIYDMREIPRYARTPYIEDVFGYVQVDDKGSMIPNSYQKNEMYQICSGKTGLPVFSEFLFETLQEKCEKSSKV

SEQ ID NO: 25291 - protein, 65 aa, Candida albicans
LYFWSFCHWEASIVRKSATTYPVRKVAALPLEQIDKHLLYFTNSVSTSTSSLVNSKFISLVYLPV

SEQ ID NO: 25292 - protein, 61 aa, Candida albicans
TELNSTRILNFLFWSIVAHVACACSKFHVILYLVLLNSKNFDCEISIMDFQKLLLKTLTIN

SEQ ID NO: 25293 - protein, 63 aa, Candida albicans
VQFSSVFSRTTTIHTATTTTTEQQQKKKPKRKKEKKILNDIPNTNYIIIIDTSYQLHITKHRN

SEQ ID NO: 25294 - protein, 202 aa, Candida albicans
FSIMEKVTEHLNEFKSKIPNSVEELQDYLDYLKEKIPTSYDDFKPQIEYVKSIKGEDVVNDFKNLKVSPITVSLTLVAFTTLYLFGKLIGGGRAEETPKKKPRKKLTKAQKANRQIQEILDYVELTYVPEIDKFIETYKELSSEDVEYKFNYFEEMLLKELMKLDAIDVTSNEILRDNRRKVIKFIQDHQKRLDKFKKEIST

SEQ ID NO: 25295 - protein, 65 aa, Candida albicans
WIFFSTELIVGHDNLEICQALNTSDELIITEQVKKAKSSKRETIVNRLSSSLNEQINKEKWIGCS

SEQ ID NO: 25296 - protein, 61 aa, Candida albicans
HISRLSCPTISSVEKKIHQQNQTTREPNQRIHPQSIEKSGEHQACKNILLILCIKIIHIHI

SEQ ID NO: 25297 - protein, 83 aa, Candida albicans
RKCGSFQPRGEDFFGAMRRDEEKKSIAPSGTKQLNVLDHHPGHTTLIRKQPTGTTKEKEKGDHRIRGGTLVLLIFLIRHTYYY

SEQ ID NO: 25298 - protein, 70 aa, Candida albicans
ENAISRVLHPRTTLHLPRIYFSLNSAFPITVSPIPGTLYPVQLTHKIHTPTVITYIILIASKPECLICRW

SEQ ID NO: 25299 - protein, 77 aa, Candida albicans
SMSTVIGDPNIITFSIKPYPPRLAISIRQEYINLDPKENPTNVIGLTPKFPEIMVSAKILPAFQARSKETFQGLSNK

SEQ ID NO: 25300 - protein, 140 aa, Candida albicans
YQSIEINQTRRRRRRGGGGGGRKQEEEILGEGEERKKSDKNNNSVTQFDVNVMKLVKTNLLNNFGIDEEVSGYEDDMDVEDEGDDEDEEDEDDEDEDQMGNLINIKKLSENGSNNVSYITSMLQNFVNNATKLSSKEQRQ

SEQ ID NO: 25301 - protein, 65 aa, Candida albicans
  UNSURE (19): Identity of amino acid sequences at the above locations are unknown.
CCVDIYNGLRNNNLQPAYXFYQCNYTTMVTEIKSKSTYVYQEIPHNTTTKYSSNCYCCDSIFQRK

SEQ ID NO: 25302 - protein, 63 aa, Candida albicans
LLTVRFLYFFLFFCIVSNAYISKINQLFIIQQGCRDRIYQGAKERADEGEGGGGQETARLSSS

SEQ ID NO: 25303 - protein, 68 aa, Candida albicans
  UNSURE (4): Identity of amino acid sequences at the above locations are unknown.
LSIXALVQSEVKNVSHKIKRYRMRIKRSLENQYRTNAKREIYTEKFDKIWWSSVFCLALASSYFFLKR

SEQ ID NO: 25304 - protein, 71 aa, Candida albicans
TVYDELVSDFMDLVLCPLDDIHRRFRGCGLVEMNGKLSELSGCNYFFLPENRYGMQTLVTTNNNLFYTPKV

SEQ ID NO: 25305 - protein, 216 aa, Candida albicans
FFSHRILLVEVSMNCKKKISCSQKKNTHTSISPTYLSSNTILYTTINLLNMLSGVRQQSKLFTKSISQVSKRYNSSHNHHHHEPESKPLEITFAKIFGVAAIAGGLLVYKNKDKTDKPLFSSKFFDEITTGERSHLRDEQYERKYKIGYLRTFDRDNGGIGQQLNKVSAYELPNNNLIPAHSPFGNQFGVGIKTNELGPRRERAQRFAPLQQPAEN

SEQ ID NO: 25306 - protein, 91 aa, Candida albicans
AITLTSIHIKFHSYNMTMKPFPNNSLLLLGPVFLVASDFVITRFSQSGAPKKLANNTRQQASSSLSISSYNPHSYRSSWIQSQLEKEPPSK

SEQ ID NO: 25307 - protein, 90 aa, Candida albicans
TGFTRGISTLINYKASVVKYGVQNPSYSGNEHTEYKEQETVFEKLLRKREGKSVEKNIVRFAVYSEGCLARTYNSEFLSDNYQVIIACNK

SEQ ID NO: 25308 - protein, 82 aa, Candida albicans
FTFNCSMILTSRIFNLEHKSWTGCGKHVHEIMDISSKDNWCTCEPLDKDEEVFIEGHGVYPPKAGQGLRRGSGCGYQSSSPR

SEQ ID NO: 25309 - protein, 65 aa, Candida albicans
RGTSIFFLVKLNNSKNKVIIFCFAYVGTKQVLAFYNNCSGDCYHVNDVSLWNGKEYLRVQNKHQD

SEQ ID NO: 25310 - protein, 66 aa, Candida albicans
YLNWKLDTREIRGLWKSHFIWNTYFEQDVKSVGTSKMEVSEGFQVYCREGATHWREFKKLIDRREN

SEQ ID NO: 25311 - protein, 71 aa, Candida albicans
PNKKGGQKKVAGKPHCCSSTTGQSTFITHSVRYLFSPVNWFMQMGMILELEVRHPGDKGFMEKSFYLEHLF

SEQ ID NO: 25312 - protein, 61 aa, Candida albicans
IQNQLKRRVLLPLSKIRHLGLFFLCKYIDYKSYIHITIIIKNTSHPHIYIHKYQLRQLHWF

SEQ ID NO: 25313 - protein, 71 aa, Candida albicans
  UNSURE (66): Identity of amino acid sequences at the above locations are unknown.
RNSKKKKEKAWPEKKKTTLKMCSVLTIKLLMKKKIEKVINKEIKKKRGLRGVFYQQKKILQTCLWXLELFN

SEQ ID NO: 25314 - protein, 85 aa, Candida albicans
LLSSMLFEPVKNYSILFSITDATYYDFDKSIQYGNIEGQAFYSNFKGNLVSCSVVMIRQEKKKLVKIPILSNRCGILVKLPHQEK

SEQ ID NO: 25315 - protein, 62 aa, Candida albicans
YSSTLGSKNGFFEISSDSKDEFDSVYVIILLSCFFKELEVLLEAIEFAPRLAMSFSVTGIVY

SEQ ID NO: 25316 - protein, 93 aa, Candida albicans
  UNSURE (62): Identity of amino acid sequences at the above locations are unknown.
RLLIIITCLGHINRSTETMSDKRDLPTKYGYDNSSKHTPDSETDDHNKTNQSQQVIDEKNSXENIEIQVSSDNDLSSLESDQLTKNPFLDPKV

SEQ ID NO: 25317 - protein, 75 aa, Candida albicans
DCVEAQHKKKTANTSKKSLKTNKPQKKGITHNLIQSNPIPWYVYSKQQVTFFKSLLFLLLTLSSLLYSTSNLYYK

SEQ ID NO: 25318 - protein, 71 aa, Candida albicans
YNYLFLLVVCKCYLNSYNSFMELHNTGALSFPTIFSRFTASHLENNILTKAKSKSHSSLNTDLPMNLINSL

SEQ ID NO: 25319 - protein, 67 aa, Candida albicans
GLFVFKDFFDVFAVFFLCCASTQSHSTYNQPILSPIKHESYTFYYTSIQIRLFQFLFFEIHIMLSTL

SEQ ID NO: 25320 - protein, 65 aa, Candida albicans
GLNLSPILANFQNTLRIPDFRLSNIAGAVEWTYVHVQINNSITCSKDWKLNKADLRALVGEIEGF

SEQ ID NO: 25321 - protein, 67 aa, Candida albicans
YHAHGFVFRLNISLSKHGKLTIFVVYELQNQGKWQNITPRNDETANPRIMAQVSKVSKRCCWIWLCP

SEQ ID NO: 25322 - protein, 104 aa, Candida albicans
RQVKRNLSIKFHPEGSLSEIVLNFPKIFWISLDVAPAKTNQGGATGLIYGSLTANKSELYVLSTPNSKIPQDQANTINCLTNLNNSKTPPCCNQHNLKVNHLEI

SEQ ID NO: 25323 - protein, 129 aa, Candida albicans
SEIMAGRTRSRTSGGDTPENHTNVVPQENLRDENNSHSENASVRDEQANIIHDLPNQSDDMEIERPFIFAKKYPDGRVLLEMDPLQHYEISNIPDLFKDQMILVYEECYSLLRQLSTRLSESIAPTLTV

SEQ ID NO: 25324 - protein, 83 aa, Candida albicans
DEGDEILEPKVGNLGAGLLIVVPLDEDEEDDVDGATLENIDDEADDDENDVEEPLIEETSFLVLFINDIPLILLPFLKVALGT

SEQ ID NO: 25325 - protein, 95 aa, Candida albicans
LTKKEKEKFVLIMYKISILLICPNHYLRLLAVKQAVDAVMDNDTAKGLHKKPYTDLINFILERNMTVKKDHFLHKYYTFHTVRVGAMDSDNLVDN

SEQ ID NO: 25326 - protein, 65 aa, Candida albicans
MDKNYKYRAFILPELLGKPTVNYFGSSQGVHSHGMLNGSLLAYPRIFLYDFKQGDALLEVYLPSN

SEQ ID NO: 25327 - protein, 77 aa, Candida albicans
KNLLFLIEIFINDKIEKSNRIDQIFIDSTYYTANSYCDITEFIVDLLFSNKNRIIGFNQNNPIPIYKFIHKHITVPI

SEQ ID NO: 25328 - protein, 263 aa, Candida albicans
  UNSURE (250): Identity of amino acid sequences at the above locations are unknown.
YSSARMNNGSQNQSANNGQQPQQQINLQNIPPQQLAQLVTAMRTAYDQAKNSTNEAERQQHFNRAENIRRLLARYQAQKNRLQQQQQQQQQQQQQRTQQQTQQQTQQQRNLTEHQRQIQAVQAQAQALAQMNNNENFNAMSNNQVGTPMMQQQSPNMMLQSPMMQQKQTNVGTPMRQQSPLMTQQSPPEQFQAQKSNPTPQPQVQQNVQQMNQNNVIRNNAIVGTNGAAPGQINGVPIANSNITMERFSXIRQKLILHRRDGN

SEQ ID NO: 25329 - protein, 99 aa, Candida albicans
SILLLFSILSLMKISIKNNRFFYFPRFFFSALFFSFLQQTLLAEGFGYFHATHHNFKNNDKQLTSFKAIVLLHLIKLKIVTFFEELDAIKMLRTTILKN

SEQ ID NO: 25330 - protein, 67 aa, Candida albicans
PNLLLALRCGPKYPNTYGTGTMAKAMNAKRDPAQPIPKFSKHCTVKRGKTDANVYLNKLLAAIAEAT

SEQ ID NO: 25331 - protein, 67 aa, Candida albicans
FCCLEIYNIVTKYFPPETNEKTEKKNKLCLKRVLKKLRLLSSQTLQGCIVFVLLFFFFFFAGTIIHS

SEQ ID NO: 25332 - protein, 158 aa, Candida albicans
MSRDKTLKSYKQVITEIAKVLEYDDKDFSKVAKSQLYSYHEKLAKGVADMFADVISIESLHLDRMELFNQHFEQLLERKKQQELRRKLREAQKAAKEEQKEQETKPEEVEIIEEEDEVVEEVPKQTTTDDSLEQNTNSVDENSSTENKKKPDVEHDEL

SEQ ID NO: 25333 - protein, 120 aa, Candida albicans
LLFLLQYPDWLHDLYKYSFTAFTNAIIKIIVRNNFILTWIVNCSKLLQLRSDVVCSRMGRNFKRGLCERKKKRDESMDSVSEVNNQRNEALFQISCCQFCFCMFMWFKEYFRGNDKEFIQ

SEQ ID NO: 25334 - protein, 96 aa, Candida albicans
LNNKVHERTKMIFWCNRNEMKTFNGKKNKKKNLLEALADLQILTMRGFIFVVETMDGRHLSQQAPLPPAPPAAGCKNGNNPHLQKLIPWKHAINGV

SEQ ID NO: 25335 - protein, 87 aa, Candida albicans
KLECATVIKIIFFNTSNFFRIEQKKIDKSAQYFVTPDSINVYYYLIQLVCIRHEALSYYLLRCRGTFHCLAPLNQLKTNEWYHHNYD

SEQ ID NO: 25336 - protein, 89 aa, Candida albicans
INKTIEEMRICGVDNTTNKTTRHTYCNNMYEYLLPPLLIPYDYYYNVVSSNPIHSLTQQRRTKEQKNKEKKEKNRVSLRNLIFFLYMNI

SEQ ID NO: 25337 - protein, 552 aa, Candida albicans
LAMYTTIEHQQQQQQQYEPMPESQHSSYFKTAFNTTRPLDDYEDQNTTNNNKLTNSIQKLSINTNTGHPPPPPPPPDSKKFNFVCVFFNRILNLKDPTIILEKNKDIGKFNELVKIDRQQSKQQPIEIMRDLFSPADIGIRDEIKVKDAKIKTTMLKEVNELMETELKDVNDQTTFEEITLNYYAKLLVAYKVYDIPTRTIYNSYPNYIQNSILLSLEEEEEQQQQQNQNQNHNEDNNKNLEFDFGFLEKPVYRTSSNQSNSSQKSKDKRSSNGSTLSRKRFLSFLGSNGHGHGHGNSSSKDSSPDHNHTQPHSQQYHHSQMASPTTPTSQINLPPPNLHLHLHLHLHLLQQSQHHQHSSLSSSPTFQQEGTFNNLLTKTKLYGRIKKHRESQASINSTGSQHSINSNRNSVSTNATATSLGSRRRSNYTINSFGGGNSAAPNTPTLSLLSSSISTIQDEHFHQENHTSYSIQELKLENLKEKYEYYIQILRLFKNSEKILKILINSHNINNKLLKFIEFIKKKLLKFIMIDIMSMILTYCDLQCINFYNIK

SEQ ID NO: 25338 - protein, 75 aa, Candida albicans
VPSLINILILYLDGKLRSNLTRIPNPINVANEQCVIVGVILINTSDIPPPPPSPPSPPQFGGLVILMSDKFTTAN

SEQ ID NO: 25339 - protein, 309 aa, Candida albicans
YLILMLIRPFVGIDQDNHNNHDTNSNDNNDDNDSDDSDDNLSPLSICLNAIDDLYESINRFQKKHGYRGGSIFIVYSSILSISILLLTNSRIQLASEQKNRLHFFMDVLYGCSKTWKLAEKSYNLITEKLKHLYEAGELKDVFEFIIEKKSSPSATNTSGNGLNEASGNNNNNNSQSIESNEFKLPINNKTLSKLKHNQQNTNNSLPTYDTTDTINSTSGATTTNNSTTFSMDQNLMEAPTPLSTISNGVNNNNNNGGGGGGTNTSSATDFLTDDNVDFLGGPPVLMTADLFNEDWEALFPDYIFNSKN

SEQ ID NO: 25340 - protein, 389 aa, Candida albicans
KIILTKYNNDPIQLIQQLSLDLTKKETELVVLRQEKFRREQKLYKLLQKLGNLSTIEIDQELNQVDDKLNKNIDKIIHDMIQVAIDDEIVPPRSKEIPKEDLQVRKKKKKKKRQNPQRNNNQSDKDAKYKAKRKSDPKMCEKTDSQQPFQSKNSFFTKTDTSPEFSIPKAPVELQNFRSQSLLQHPGSEKKSNSFRFPLLVQNEEVDIDKYGFVKEFRSNTPMTHQSSSASASASASESSSPLPHGQQQHPEPSYESSAILINNHNSHSKLHLIDQLKQISQIHDSTNLYIEKEWENLINDINRQFYTNHYQNNEPKQKQTKKDNDDDRELYWRFGIRGSNLLQLKNNQQFYYPFINLINQYGIPNKYRRILWLELSGSNLPRPAGKSQ

SEQ ID NO: 25341 - protein, 68 aa, Candida albicans
FDDFEAAACAESIIGVLIRKYETSKREVSKFLNFETTLEKHSDSVVMGKTSRGKSCVSRWCACFVAIV

SEQ ID NO: 25342 - protein, 75 aa, Candida albicans
IGSINQNASVCGGGGGSKTVNCDNSTQKLSESIITTILGNIDGVLQLIRFSPETKQRNSKSHTDLHSRYFPYPFT

SEQ ID NO: 25343 - protein, 76 aa, Candida albicans
IEVDHLLNLFLLNIIQRILLVIRILESNIKQSDIFIKAFSALYYIEIIAHNVCDLSYPYPYALDLQHSGGTSAIAL

SEQ ID NO: 25344 - protein, 110 aa, Candida albicans
KRIDKKERKKKKKKKKKKRRKKEEKARKKERRERMKEHEKRKKVKENNKRKNKGTKKKKEEKGKKIRKRKTEKKGRRKRSNRRKSKKSKKEKSNEITIKRKRTPKILHHQ

SEQ ID NO: 25345 - protein, 436 aa, Candida albicans
TMSSLDHEIEQAILHDRFLRIQGVIIDHSSGKVTKNGTLYDYRRKRSRHQRHSNLNDLTKGIFTLPEEIIYKILDHVNQMDTIHLALTHRSFREVCKAKLLENICVYYEDPRTNLIPKNWYISEYTNYTFVNGLNFEKLYFKVFKHVKHLFFRNVVYKTGSIVLHNLGEQLNCSITFGAVMKPEFLWWLLAYQNRIKPANLILFYKKDFELNNYPLGIIKELSLDFTFLGRTPIKFSLINEMPNLKKLTLIDPQNLQSPEPVDILDLHVHYNFCPADIFGSFNLNKIKKLRVFYWWKTRSFPSLVYNADKLTSLESLDVTFSEEELVPFDRSLRKNSLIEIGVPESLKSFETIYPALFHHKDSLKVIFENKDYYRIISYTDQEISFDTSFNVDLDLTEFPKLEYVVRNGGVKLVDRSGPSPQFVPVEYYSKNTPSY

SEQ ID NO: 25346 - protein, 83 aa, Candida albicans
LIKMKKRKKEREKGSVRKHSIFSSINYYPPTHSLTHPLTQYSREEEEKKEKRKNYLKVIQSYSSLKISFLPPPPPPQQQQLTI

SEQ ID NO: 25347 - protein, 70 aa, Candida albicans
TNNLSTMSGRQGGKAKPLKAPKKKQQDFDEDDAAFKAKQKADAAAKKAMAEKAKKGGPLVGGGIKKSGKK

SEQ ID NO: 25348 - protein, 83 aa, Candida albicans
IIEKRATHFYILYFTDILNTEISEVIKRTGWPSWLRRETVISKIFKRHLKIESSSISMVAKIYIFFHFFTNLIKLINTFLFFF

SEQ ID NO: 25349 - protein, 71 aa, Candida albicans
IGLKKTYWSAYQEYHQTGKINKTFYIIYTPKISKEEKSHREIPFITLISPSHNYCIDLGPPSFLFIFLIKH

SEQ ID NO: 25350 - protein, 296 aa, Candida albicans
DLSTKQEPQQQRQLWIGFLRAHVKDCGCGGSMYRPNFLILEKLNSKFKLTYLSGSINFNVSVYGWANYDVVCAGHEANALIPNGISMFDQDDDYLTLSMSVADQDNTLVHIHGVKKLIYLLDHDWNGILKENKQIECVVNNANDFCKAYADEHYKLGDSEAAVKEVKQKAKEEAEKAKAEKEKAEKEKAEKEKAEKEKEEKEKEEKEEKEKAEKEKEEKEKAEKELAEKELAEQKDEDAKDEDKNEDEDDKEKNDESGLTEKSEVEENGENANEGGEDDGDGDGEEEKEDDDDIDV

SEQ ID NO: 25351 - protein, 88 aa, Candida albicans
KIMQSSAFICIFFPPFTQGVLRLENWETKFDERTKNFTDYMGKEMESLINKKKNNGNRSSLHNVVKGAAYMLLSTSILLVQFFLFTLH

SEQ ID NO: 25352 - protein, 68 aa, Candida albicans
SQPWNLLKLSNLPKLPKLPEQPLWFYLAYNLLIPSLLVIVVHYNYELKPHQDLIFMLLYIDCALQRLR

SEQ ID NO: 25353 - protein, 71 aa, Candida albicans
EGSMADSKLTENDIMYKKTFIILNNLYIYIKCTCHQLAVAFDDAFLLNIPLRTSFTISTNINPYTSCFDIP

SEQ ID NO: 25354 - protein, 235 aa, Candida albicans
  UNSURE (110): Identity of amino acid sequences at the above locations are unknown.
NNSMKTQSLSILWLRLYILILFIRNCLCDEKIIDSSKYGRLTITNNTSQDTLEVANTLPNSQPKMFMHKTETYSVEVINATTLSENTRKKRFDVSGPVRTPAQANVCVLXAAFSYQVMKDIPNGIKYLLKTDQCQTDLAMVEVYRDIDVYWQAGEITGSCDLIRKSEIIELVLQEQIDEVYNTRICAFQCIKLRRGLDWTFYLKFGTSRDLVQYTECSSKTGGFSECREGEINDI

SEQ ID NO: 25355 - protein, 76 aa, Candida albicans
INITCNLLGLLSPNHVTQDTFNCCIIVTVVYYQICKFILMNPFFFYTINLLYPSTFTNDCSFSLTSQKRSPTLKLP

SEQ ID NO: 25356 - protein, 75 aa, Candida albicans
ENMGNRDRTELIERVFFWGNGFNKIFQDWNQIMSDVKKSKYNKKFKSLKILCKYNDYQLQSTNRIKQKPAYNRYQ

SEQ ID NO: 25357 - protein, 117 aa, Candida albicans
VQLQIVTPTPTQIQSLVISVIPVMQCPQKLVSTPIPTFVPVPLPVHSVPLARPPLFGKPPGAGSSYSRRKAFGKPPGAGSSLFRPPTFLSNKPSYKRELEDDEEEGEQATNKIAKTE

SEQ ID NO: 25358 - protein, 81 aa, Candida albicans
  UNSURE (39),(40),(41): Identity of amino acid sequences at the above locations are unknown.
ERDKNQLREKENSRLYQIRHDHVFDGSLSHREEFLSSLXXXKINNFFQILDQFGLVPACSFPLICLIIHHFDNAFLLGDII

SEQ ID NO: 25359 - protein, 121 aa, Candida albicans
SNNTLLCFSLSLLVRLFFFSFFLSYCLGNRINFYYADIFLSSLSLHDLMYGKLQCNVTFLSSFVWRIKPGTKSHDLKKLKTKSSEHKHELDKNTKTIFTTWGEEVTQGDCRLFSQTGMFFF

SEQ ID NO: 25360 - protein, 64 aa, Candida albicans
SGICGKWSLKSKDMETTLRDTEVDVAMEVARELGSTERMNSQVIRSGSWIWERKSENEKSWKLF

SEQ ID NO: 25361 - protein, 89 aa, Candida albicans
YLNWKLDTREMKSLWKSQIGWKIKQRCQISGWLRDGATSNARTRRERTAMSLEGILASCMKAEKTASESQRKYSWERGPDREKGNEDGV

SEQ ID NO: 25362 - protein, 85 aa, Candida albicans
RTNFNESNSHFISCNLSPVLAFQILTYSSLATVANVNSVIGLKDKHSTAFRWASTIVFGSTTEAGRHFQILTDLSVREYTTLVPV

SEQ ID NO: 25363 - protein, 114 aa, Candida albicans
TMIFQRLVNTGTWVFAPIQKHYAYSEDLSLQVPFYVSSALCLFSAFLTIFFVPPVGQDAINKEDRLFKEYLEENGFDIRLLGDSGVVTQYQEDEDIGVISDEKDDTVKVQQKNV

SEQ ID NO: 25364 - protein, 297 aa, Candida albicans
LVEDYDYTREKSHCHVIDLVGITKSSLALKATLSGEEPQEQEKRKYKDEKDSEEEDERLDDLEYIESIKSLRARRKLIVERALYYYNHGVSELQTIDGIQLFQRYMLDIEVVKDILMKGKLPWVALHRDSVWGVGGLDNTFFLIEKIKTNDRIEFKLTQNQLSRHSNSNHEEVEHIYTSSNILELMQKLDDTFPEHASYTAKYNTFRRKCHRYFAEFIISKLNTRISKYCHENGLERQQFLASLNDVIRGLHLVTAYRLKFALTYSPHCDYSIWKGNQLLAQAVTNCRKNTLSKYRD

SEQ ID NO: 25365 - protein, 216 aa, Candida albicans
RTKGSMKSMISTINLIVSQGSDKKEGANGKRKSRSRKGTLKKEQEEEEVIKVEQSETPKSISEQFMTLVDTIGGLIPIPFLSNTVVGFIIVLIGFLTTVSVFNRLTSTSPKQYIELIPNDYLYASRIQIRDNKYLLLPTVETSFKNERLKRQEELSLWSWLNNRSEGRLNLNYKAPSLDELDDSDLKSKYGEQELKEIVRLTRIKLDKLSEKLDDL

SEQ ID NO: 25366 - protein, 66 aa, Candida albicans
QKLYVSNSKSSLLEVYSSDDFEGDFFTFILPGNDDANDRVDDDDANNNDGVSDDDAGDAGGGAGGG

SEQ ID NO: 25367 - protein, 674 aa, Candida albicans
TGFFHRVVDKKKSTSDSQQQLVRGNHELRRHSQPNPIINYEVLHSTSTANGRNHIRQNESESVIIDESTDQEMSPLTSTQSSQSTALSEANTLFIDRHQRLELQDNYLDNFTMYLPFVIRQMRLIEERRYLESQEYRNENEQTSDNNDPLQQQQQQQQQQQTSRHVVIPDITGDDLDDISTIFDEAHVPLETFAMNHYKILEKQLSSFDIKRLFIIVAGMLKHNTYIFPSAESFELFKQLRSSIKKHRKNLIMVYDNQGTIKRASLTSSTTNIKREDINQESEGIIIDDRPHIIPLDQKLKGLGLPLFKIQTPYLSSFRKNTPCIIFKRYKEVPQPPPAPPPASPASSSLTPSLLLASSSSTLSLASSLPGKIKVKKSPSKSSDEYTSSKDDFEFETYNFCQVYSKYFQSYRRFIFEFTPLDQPSFKVIMFQSNLRPFADLLYKKTRFRVIGPAMLLGVIQNYNPHMRLLVIDDDKPSLVDNIINKKPHSGSNTSIATVATNSITGAAAAAAGGLFHKRKSNDKKSKTYVEFNYDDPTTFINPIPNNTFADEDNNANIGQAINTSLYISNDLPPFGCFKDSMLYRTNSSLLPKKYTEEGKIQMYQDKLFLIDKDENSTLSIDIDSMVLVCIMATLRDISIKNAGRTNTQRAFGIGLGNRIGYGLEPSHVGIIGL

SEQ ID NO: 25368 - protein, 80 aa, Candida albicans
FIQSKMSLDNSTENRDLEEKEEIPKNEHNEQGEQNENNEHIPTLEDKPLKEYIGISILCFPYCLWWFRFWFRYWYHFWFH

SEQ ID NO: 25369 - protein, 442 aa, Candida albicans
  UNSURE (154): Identity of amino acid sequences at the above locations are unknown.
ISVKMNLKSQPSIYPKRYKKTKTNMLFQLPPEIMEIVLDNLHQRELLQISQINKYFRHLTLLRQYSVISIDSSPKLFQRDTKSLNDFQELRGVYQLDYYSIIAVNISSVYCLILFFSTLIENPQYGGLFKIFPVQHLPDIPDLHVVEYLPKILXLMNTLKVSHGEHSYPVSMKLLQYNLQLTAVRGNILCDNINMDAYPLLNEAVLTVTDFHLPLRKLTIKNVDLNNISVNTTLLKSLTIENCSNEKDFLIKLDAPRLEDLSLSIEDQPFFAKMFSQLHLKSLKLSIPEQCEMLKVSHILNFLNKDISRLEISNQPDSHSYKILPKFNNLDYLHLSVLEKDIYKLLSSLTKKLRFLSLNVLEATERRNCLIASEFWECSMIDENQLKYTDFILEYHRKLDRLKWLRFQGNDTTYIFECNESEPIIFRDGFYHYFDRIVNTLI

SEQ ID NO: 25370 - protein, 71 aa, Candida albicans
YQIYYSQNLMPSRLPCLYSVIFSLKWYRRTLLFWKIKTDHLHPETAFLSRKTIHAVLGLLQMIYSYYLLTF

SEQ ID NO: 25371 - protein, 77 aa, Candida albicans
CCCVIHLISVTCFLVCSWMLGNNVKNKVKEKERGGRKELLRNVSYLSLFFGVNFMLFHFLIDRGLSVVQTTGINNNE

SEQ ID NO: 25372 - protein, 80 aa, Candida albicans
PLINFFLVAKIIIVVRDKKKINSNHLDLSNRESNLCKILFLFFQCKVHAKTNIFVRGEKIDLPKVHASSPQIFLPPSSKS

SEQ ID NO: 25373 - protein, 292 aa, Candida albicans
PPSGVVKTKEERDDSITGAYKKKVTYNRLNKLKSKSKSNSNSNSNSNSNSNSNSNSNSNSKPKPKPRPKPKPKPVSKNILKINQTSNINPWNELLDNIEESTVYLPKISLIDDENESDENDQVQIGVNKAQEGGETITTTSIINLPILLNFDNEGEDDEEDDVEAEEEEENLQQQLIQSRSLSTSPSNSNSNSLKPNKTYAQDRSYLILDQSYIDVKQELGEYISRKHDFDNNNNDDTEEDGDDKDHEDINNNKLSSSSSYSSSSFSSSSGGGRVIDPHVFNFHLQNGRVRE

SEQ ID NO: 25374 - protein, 92 aa, Candida albicans
SLFLVIIYIYKSIDKKTSNFQFRYYFFLEVIKEFGLLLLNILSRPEDVYYETWIFPARDCRGGSSERVSECTTFYTVTINNKSGRKDTHKRS

SEQ ID NO: 25375 - protein, 97 aa, Candida albicans
NNQYLFIDSIKFFLVQYIDISIMVMIAGKTQYNYNKPMLNSFSFLFLFSNLRFDMNIRKQFYELPNFEKEKNYIKLNQTRQKKGKLLKVSTNGPYDK

SEQ ID NO: 25376 - protein, 67 aa, Candida albicans
NNMSGLTLNQIELNQIKSSWNKINKVDFYPDLYVNLFELDPQLRSIFNNNDSVISVYTPGAGRKRVE

SEQ ID NO: 25377 - protein, 88 aa, Candida albicans
CPEHALLRRVEKNSGRSGGAIAFTNDELRIIPQTDSMMLGGSDTTDKCTCNPLTFHQQREAVIGSWTLEASVTKSKSLVGSLLLKRDN

SEQ ID NO: 25378 - protein, 268 aa, Candida albicans
GTLCADPPAPRGEDVPSRRRGNPNFRRGGGGAGVSTRGNRHHPYRSNPSTRRDTDSYIPRPAVSSSSSIPKQVSLLANGRPTLRIKNIHPELNGEDLSNLFSSISPVDFVKFDDDNDTIAYICFQNDCERSNLEAIAKFDGKKAMGKILIVENTTSLLDRIDTRNINHRITSNGPLHSSHRSYSHSHPRGTSSGRRPPRERKIGGGTRPAKKTAEDLDKELENYMGNTTDALDRELDNYMHETTTTNTNEPSGEQVATSTTNDEMTLD

SEQ ID NO: 25379 - protein, 63 aa, Candida albicans
CYNNKYVKESQREKQKKKKFFNPFTSQLTFLNLLFFFSVFLYILNQQQQQSINRHFYFINYKY

SEQ ID NO: 25380 - protein, 67 aa, Candida albicans
FDSNRKNENTGNNCIEIVEGKKKMHSSVSRVLMQLSWIEFYSSLSDIIFFFFLLLLQCGITESTIDK

SEQ ID NO: 25381 - protein, 69 aa, Candida albicans
FLIFEGNKNQVRKKEKVYRKVKKKNLRKSNLWVGESGVKYPSVLNLDQLRQSEFVDNAGKADTEQKQPK

SEQ ID NO: 25382 - protein, 278 aa, Candida albicans
KPFENEHGNPIPATKLLDESLSDIINDRIQYNTLLDDNKTNEGVINVNDELAMELKLIITQQFSNWITPFPHQPSKSIDIDGLVISSCHDKKNELIYLSSNDCKVYVIKQKQIIHTLKMPVVIKKILTIDNSDKMVLVGMNGILYLRERGTLEEIDQFQAHKRLIVDAKSITFQNRNYLITLGWDFHLRLILLNENNTDQNEVQRFEILSELKLKQQGSCLDVTVYQDQLVIILGKTENTLLDVITMSGKDSRELTLVHKISLNDAEFTAAGFFTQVV

SEQ ID NO: 25383 - protein, 106 aa, Candida albicans
  UNSURE (18): Identity of amino acid sequences at the above locations are unknown.
QNLANEPSIKRNQIIKNXNTMSPQDRYSQPIIAWRLQKSDNNKASGVWVMGDDGTIRGIDIVEDQVIVELKDGHQGKIKDFITFIDEDSVEKLITSGIDREIVTWR

SEQ ID NO: 25384 - protein, 69 aa, Candida albicans
TIHNQRYYMTYLYILIHYVYHSCMRYATQYTHTIHKARRINLTNISWLNLTTQFPSTIFFSFIQLTNLP

SEQ ID NO: 25385 - protein, 73 aa, Candida albicans
INKSIANCGTFPIETEGIIKVECFKSGLNTFLNEVPDEDFMFHFLVCRDRSILVFNYEKKKKNKVICFIFFRD

SEQ ID NO: 25386 - protein, 102 aa, Candida albicans
FYFFFFFFFAALRTENTCKYDHASNHQMHLRQVSIGLVSECLISFLLFFCITPPIPNYKVKLNRFAFFASDFFTLQLTTIIRTIDKHLFNLKYNKVDCNECG

SEQ ID NO: 25387 - protein, 61 aa, Candida albicans
LSTQLTTKLVLEALFFQIIINLRLKEPKLVFTTTLARHLIYRIEGSNIDIKDSVKNSPIGI

SEQ ID NO: 25388 - protein, 69 aa, Candida albicans
YYSSGFKTKFHHQPPSTTTYFPFFFAILILAELKHYIFPTVYPLEEERFLQTISSIFIFFCFFLPFSVF

SEQ ID NO: 25389 - protein, 70 aa, Candida albicans
NLLSLYFNVVVNTKILHWLVSRLVYFNQQQIWFSMRGVLRINSIILVVLKQSSTTNPLPPPPTSPFFLQY

SEQ ID NO: 25390 - protein, 61 aa, Candida albicans
FVTEHIAVISFAFTFNGDLPFHCKTNQFNNDTNTHKNYVSKLCKQKVLVNKLRNTIVRIIH

SEQ ID NO: 25391 - protein, 228 aa, Candida albicans
  UNSURE (180): Identity of amino acid sequences at the above locations are unknown.
FTIIMSTTTTSQINTNPITHQPPPNNPIQFISLISRNDKPLYIQAFNIGEEEEEEEKQGEKQEGNTTPMNHTNADKFLKYNFLSHMALDIFTSPSSLSLREQQQQQQQQQDTHQNGDQIPVILLFIQDQVMVYGYETNNGLKIVIGLDQTRNFNDNGNGNHQNSLTKLRKLFLDVQKCYXRTIFNPLNQIYINLGTGISLNDDDDGDDSILQSHTFDRNIKKLVNSYI

SEQ ID NO: 25392 - protein, 76 aa, Candida albicans
MIDSHHHHHLLLLLSPQNQCRDGSRTNSSYPGPSTLFQIHTFSNKASPQAKKKKKKNFSPIVEPIKLIKSPTKRTE

SEQ ID NO: 25393 - protein, 75 aa, Candida albicans
KIWLSSYYYPLTLFPFFFFTHIYELFIIDLSIILFFVCFFFYKNFALELYYKTITIPKPIYLSIYLFILHSLVLL

SEQ ID NO: 25394 - protein, 128 aa, Candida albicans
  UNSURE (15),(16),(17),(18): Identity of amino acid sequences at the above locations are unknown.
SFAGTRITNPWSVLXXXXPVGPTLSKIPNSSLGKLEITPFDDSEPQQQQPPTNESPFASSPFGSSKVVRKRKTSLGKIVSVKDNLGLVMLAVSDVEKCQIYKLELPSFEGGTQFIGVKVGIPDWWPVN

SEQ ID NO: 25395 - protein, 89 aa, Candida albicans
ILYFFHQLLFINFYIFIFFFILQPSTVSLFLYIFENIIKQMAASDTQSTSDETTPLVRSDESRYIPKDQIEYEFGGPIGALGMMIGFSL

SEQ ID NO: 25396 - protein, 123 aa, Candida albicans
SLWKKKILNIGRDGKTKKNPSNESLFVSICRFDRVYQRWIIKYHKDGIKKNVKKPDVEFSEANKTTTKTKNEKRKRTHSQMSKKIIDYCQSSNPNQLVMYVSMAIILDITNSGILFSCLKKIK

SEQ ID NO: 25397 - protein, 97 aa, Candida albicans
  UNSURE (51),(52): Identity of amino acid sequences at the above locations are unknown.
FRLCDILLSIFGKPGQIDKLTQREIHLRDFFLFFHLFQCSRFFFSIATNKXXEDTDNDVFVCCCCCCCCSFIQLKGHSKLSMCSLDQHNFSFLFFFE

SEQ ID NO: 25398 - protein, 71 aa, Candida albicans
KKKLDKKWKPQLTNCQDLYVIRCRQGPKIKGNKKAPTNKTMDREGEERKSENKTKQNKTTKKVMNVKLTAR

SEQ ID NO: 25399 - protein, 66 aa, Candida albicans
VFCFQQKISIESSVNSHLCFYAFVRALNICNFVPNCSQTSHELHRHKPISVGGILAVKKTTHEKKS

SEQ ID NO: 25400 - protein, 304 aa, Candida albicans
GTFIKLINRDNCKTTMSSDIENFLKINSQTVKLDDDDNSFFFNLNTTSMGEVNFNFKNEILSNDLIYTLIGYNFDPTTNSELKSSISMNFINEEINVIDEFFKNDLLNFLSTDFHAGLDDDNGEEDDDEEAGPGSTHPMGATGSQGSLSPEPVSTGNPSVPPTRNTSISEVNAQNKRGNEAVLTPKETAKLNSLISLIDKRLLSNQFKSKYPILMYNNCISYILNDILKHIFLKQQQQQLQSSSSQLHDTQPLTQQDTAQGIGSSSSNANNTNSSFGNWWVFNSFIQEYMSLIGELVGLHDNLV

SEQ ID NO: 25401 - protein, 61 aa, Candida albicans
GCYTWRNNFSGELERLDAAKFPREKSAIFLVLVKKWINLNDLLRDFYQVDQSRQLQDHNVK

SEQ ID NO: 25402 - protein, 79 aa, Candida albicans
KKKDQNDALQPNEYFKNNNYLLNPFIVSNSGFQKKSIVCFIKLINEKKILYNINKKIKIKPKKQKQDKNKKSQNLTEAN

SEQ ID NO: 25403 - protein, 97 aa, Candida albicans
WDIFNDMFNQITTVGGTIILLERPTRDSFNLDYNLFIYLFTTKPIITIFFTTIMVYIHLNRFVLLLITFLKFVRTLSINLLLWQSYQVKKLLDHSIN

SEQ ID NO: 25404 - protein, 146 aa, Candida albicans
SIFFSGYGQLTIIRNIIPKMPSLSDLDYENPVKIASTQIETVAIIGGGASGAIILDTLLKEPSNIKKIVVFERQKKLGGIWLFNKDIRSTPNDLIKSGSYNLENDPQLPNPFHKQQEKAKRILLPINTPRYVYWKPQVYYGNHHQH

SEQ ID NO: 25405 - protein, 139 aa, Candida albicans
YYFPLITFTMMTSRKRTFEEFSTSHSFPFSEDTNSTRTNIFNCFPPSSPPPTTTTSSSYDFYNTSMDDSSCGEKRFQKHKIHSEIHTTTIEMMMNAQLQLQRQEKLQRPQQQPQQQQEEVELDGEHNNGESTYHQCPYW

SEQ ID NO: 25406 - protein, 95 aa, Candida albicans
FTLYIRSGFSITLQYHAVMPLQQPQGQSVLMHKDISSSIVCNNLLTSMDTGDKLILHCYVHHPVLLLLVAAVVVVVDVAIFLVVVVVIEHSSSFL

SEQ ID NO: 25407 - protein, 63 aa, Candida albicans
QMTSVKQREIIRIANEMGRDEKARLAEDKGAYNREGPNRGPERSGKVSRERALRRTSWEPRGE

SEQ ID NO: 25408 - protein, 66 aa, Candida albicans
ERGGIGRGGDQGKGVSHVEYNGDRRETRRGRRYVDRMESVTERVRENHRGDSVASSYTQAEINPGT

SEQ ID NO: 25409 - protein, 80 aa, Candida albicans
QCLPLDSFLFGAMIQFLKNLGFIIGFGYTGEKFVADKNNTNSNKDMGEWASESLIVSKVRNTRKKGRGRRECVLETAIVN

SEQ ID NO: 25410 - protein, 66 aa, Candida albicans
VLKNQGGREGSVFSLSELRRPKCTLTTWPKKKREERRMRVFFTKSILYFFDFVLTYTHRFKPRKIK

SEQ ID NO: 25411 - protein, 60 aa, Candida albicans
NIPYCDLVGRRLFFFTDQVRPINSQTTDEKMKCKTKKIYARLLLLLLYHVAMFYKNSFIG

SEQ ID NO: 25412 - protein, 63 aa, Candida albicans
SVDNKSENNLSRKLKTKNQIKKVKMRINKQSGGKVKKKKKKVQNQNIVKQKEIDFFFCFLMRF

SEQ ID NO: 25413 - protein, 561 aa, Candida albicans
QKPLLILNRYIQIFTITVRITIKKNIKQTKLDLKKYVNVKFFFVILCNQVADRKPFSSYNFYVSINGESLIYHYYTMHFTSSLLATLIWFTLPVQSLNTESRTTSNNTISILTNHFQILKDLLPYSKTSKPQINESRPLIKVLRDGVPINFHMAPAIIMKSNKTDDLVRNSNKTMVLTEIKTITEFATTTVSPTQEFQALQINLNTLSIETSTPTFQSHDFPPITIEDTPKTLEPEESSDALQRDAFDQIKKLEKLVLDLRLEMKEQQKSFNDQLVDIYTARSIVPIYTTHIVTSAIPSYVPKEEVMVSHDTAPIVSRPRTDIPVSQRIDTISKHKMNGKNILNNNPPPNSVLIVPQFQFHERMATKTEVAYMKPKIVWTNFPTTTATSMFDNFILKNLVDETDSEIDSGETELSDDYYYYYSYEDDGKEDDSDEITAQILLSNSELGTKTPNFEDPFEQINIEDNKVISVNTPKTKKPTTTVFGTSTSALSTFESTIFEIPKFFYGSRRKQPSSFKNKNSTIKFDVFDWIFESGTTNEKVHGLVLVSSGVLLGTCLLFIL

SEQ ID NO: 25414 - protein, 62 aa, Candida albicans
LVKRKKSKLKLESQVFWLKRCLPQRVEFFSFSSQSIFFINSLNSRLSKQTGRQTAFLFVCGN

SEQ ID NO: 25415 - protein, 80 aa, Candida albicans
QVVICVQICICICILHKQFGNKLTCIDEFCDYFSITTLQDIEQLFVVVQSISKIYFLNWVCFKTVSISTVFVHLVCATTS

SEQ ID NO: 25416 - protein, 64 aa, Candida albicans
ISFTDCFILDKIKTRTRVVFIFYQNIKFIRDLQHAKYYNLSQQNKPRAHVTQTKVSVSPLPCKQ

SEQ ID NO: 25417 - protein, 67 aa, Candida albicans
LISIYSTLKFDCVYQINFIGRLDFVISDLPAYRHVFPILCNTTSKQFFFFPPPSLKTIYYCISIILF

SEQ ID NO: 25418 - protein, 95 aa, Candida albicans
LWLCRQHNNKCLIICIIHNHTAVKVKRYRYPIIYHCDFQVVKTNGVFHIAQDVFSLQMKPKKYLFHLSEFPLLIQSIGSATVVHVSILKKSTKTR

SEQ ID NO: 25419 - protein, 70 aa, Candida albicans
KLLGNLQYNLYHSHQYHVTNFNTLSFSFSSFQELYKYFCTSPSFPIFHLIFHILLFPFLFDLLSLSLTFI

SEQ ID NO: 25420 - protein, 351 aa, Candida albicans
INRIPYNNPQPLLQPLLQPLLQPLLQLPFLTIWLPHLKVCLDINTLLFETIVLTILSLLIVTDSNGRRDHPRYRLAGVKRLMQGQNRKSSMNNHTDRSTYSNNTSDNKEDDTHHNNNNNYSNVNRSRHSNRQSRNKLVSNKNRDKIPKTEVVIESHDNNPIQSQSVQENNNIDNDEQDEGEERNSLDVMSDQISDNVSTTPLKSIVSSQSTKSPSILSGDAHNDQTSLIASTAETSLAPSVQTPTNYTFLPIITASLTNTTSSSSTTTTTTTTTTTTNNNNNATTNNNNNNNTILPVTYNASIGGQDRDSESIVTLASSTRRIRRRSIDTNCSTTGIPPASIMERLSVSPW

SEQ ID NO: 25421 - protein, 89 aa, Candida albicans
VKNFLSIHLMTEFNELQLSQTKVFKNRLNKEDEDPTIKPELSKPLTHKSTGTPLLTLVPKYFISVNVFNEGSKEPNSNGFISITVEFKL

SEQ ID NO: 25422 - protein, 65 aa, Candida albicans
NGQLCQYPTLINLSIPSQSLKNKFQLIKPNLNFKFGIDDKINFGISIKALILILIISLPLLSIVE

SEQ ID NO: 25423 - protein, 284 aa, Candida albicans
  UNSURE (250),(279): Identity of amino acid sequences at the above locations are unknown.
LSDILFIFKVKVLVVILYLNYSHHYLQLQLQLQLQTLTTYLQIYTFFKGCCIICKIMMSITRTSTATTTTTTASDISQMEIKELEIEPRPKSTDNNSCSCSSSSSSSLIPSNTTKSNHIHKPIARRNIPIELKDDNIDGLNPTEKENNMTKCIPNTKIDSSSSSTNSTSTPLIPSDIHRACKRSSSSSNDLIYERDRFRARLKSFNDTQLHNNQHEPPPGTTTKMESTSNSTINGINELCEICDEISVTXKTAKLNIDKNPLDNSTMFYKLLPNYYPDXEKWMI

SEQ ID NO: 25424 - protein, 97 aa, Candida albicans
CFIVAEENFIFGFLSFFLSFFLVREKLKRNTRRFNFYLSPIVILIFVFIFLSFYLSITTIIHPHYPHYYLISHSSINHLMCMCIYSLYSLFLVSFQL

SEQ ID NO: 25425 - protein, 88 aa, Candida albicans
EYRKSCQRDPLFLSFLHPLSLLSSTHFNLYYILILLKPLLLVYSDELLINVFPTHVSFVNINILVPSGNSFKSNKSKEVIDSVLTMRL

SEQ ID NO: 25426 - protein, 455 aa, Candida albicans
YFLYIDIMSDNEIKSSSMHHHRHHHHHQLQLQEEQLLTNEDNSYSQNQNKDSSDSCLTAPLITDINTTNNGIQLNQEQPLVPYDSSNEETPLLLNNSISTITTTTTTTKSSQSTCFTWYYIIIIITSIILIGLLWGGIIYNIVHNIESSINDSIQFNLDQVSIQLITSQGINIHILGSIDINYNDIINLIQRNSIKLITGIFGSLTIINLQPIEIYSKFIDLEENDNLSFIPLVDSYIPSIQPIDIKIGNLQTTDIDIISSCKFINNENFMKFLNDYYKLQNDDDDDEEDDKINLKIKGLVKQVKIKLWWMILYDVENIEFYKDVTIYKHDIIPTVNIDKFNLYSTIDNKGNDIINIKINALIEIPKFILSSIPNLKFKFGFINWNLFFNDCDGIDKLIKVGYWQSCPFQIVHQERENLYQPILLTVIGNISSIPDELMNECPNNNDGTSPINKI

SEQ ID NO: 25427 - protein, 368 aa, Candida albicans
QKYLDNEPIEFYLPLLSYVDEHDNGIPDWLLNFYMNTQFNLTITLPKMNIDQFDFHENLEIINHSSEVSIMNNDQFLVSHWNSNISTLITTIKPFKLVDLDINKFKFDFEISSIDNNVLVKVNSNDEYIYITMINDNQELINMVMNLPNLNISIIDAHQMGNIINKLLNRDYTDNDGEKEPDLFIEGNVYDVYGNLPIWKNNNNNNKQRKLIDHLYIPLMKLPKLSTMESFPAYTLDTLSNLTITITNLYLIESTIRKLELSIDLTIYNPTNFNINLDSSILIDSIIWQIFKNDSLISSIKVSIPDTKGGNGNGNENGNGNLFIHIQDYFNTTMKINIYSLNYRDKSILENSISSFISNDQFSNISVY

SEQ ID NO: 25428 - protein, 63 aa, Candida albicans
RGADSDFEMFKCGTKTPQTEVTVEDNDSGGICMLLVFSGLELYSTFGKLKKFEIRLASNNAIK

SEQ ID NO: 25429 - protein, 66 aa, Candida albicans
KLEKFYNNFQLLSIYLYHKVHKTINLEQCNNTKTYDYEMLHVVAVAVVAINNRLGYIPQQVTRSTN

SEQ ID NO: 25430 - protein, 60 aa, Candida albicans
IRDIHKNGMQAYESFIDSISISKLEHNIRNLFLRVFQKRKFTVDELAPVVLCLCLLHEIS

SEQ ID NO: 25431 - protein, 63 aa, Candida albicans
YFQRRFSLKNRFLTPDKNSIDIENKSKIVSLVITTGNPFVQINDGGVELTVRNSRNGSSWNYW

SEQ ID NO: 25432 - protein, 89 aa, Candida albicans
RISTDRVELQDNDDHGPSLPNRPKGELQSDTPTLTTREKGATDKKKWQPLESGVSADPDAFLVTDSEDDGEDVATTDATKNTTISSTKK

SEQ ID NO: 25433 - protein, 66 aa, Candida albicans
RDLVNNQNSKRMEDDEIDENNFTGLCRDVSLTTIPITILMYIIFIIEQRKIKKRENFVEWVSLNTT

SEQ ID NO: 25434 - protein, 91 aa, Candida albicans
MKKFNLSFGILLLFFFGLNIFNLYCFLRENDLNAFNMSYKGVKISDIEYLLYVFNIIDILSLSRVYKMLTHINLNGRFHFRVLLNGNTHDI

SEQ ID NO: 25435 - protein, 143 aa, Candida albicans
SMTFSTLNGDLNHHTLSTMDTLSKTYPIDSSTLFAKAIFENFKQTFTSTNNSHTTTTKVSMFEPISSFTTVDTTQSTIIPYRCENSIFRKKAKLVDCPSTEELEMSLEIWKIEGNDQYSGEQRRHFKPFKVLFDRIRDQGINK

SEQ ID NO: 25436 - protein, 72 aa, Candida albicans
TRLSERISIMLNTYKRYSMSDIFTPLYDILNALRSFSLRKQYKLKILRPKKNNNNIPNDKLNFFIYRDKVLK

SEQ ID NO: 25437 - protein, 70 aa, Candida albicans
STNNNNNKYGSSRKGGEHCKLHKTKTYHHALFISFFLSFSSHHCFSSLLACSFFYLHSQALSQTICFYFL

SEQ ID NO: 25438 - protein, 78 aa, Candida albicans
PHNANRHQHKFIAHVCGVMCHIRGLISEESGVNQDKPETCCKTGSGIFYVQSFRIQFREFDESFIIAILLFSIIYYFS

SEQ ID NO: 25439 - protein, 78 aa, Candida albicans
LNYIIARFKLNDSGGALPAANRQKQEVDTTSSHKKLIILPTTTSHDRLIIVICFNYTKSRCSTIKSLSYTTTMCVGIS

SEQ ID NO: 25440 - protein, 103 aa, Candida albicans
ISYFSLFLSHIYFNYFAPIFFHSYYLKFSLFTIYIYSLTNHQTSTSNHLVIFLIKINEIHKEQFTELVTLIGYNYYQCYYYYYNYKFSTTVFIFQLQNREKIL

SEQ ID NO: 25441 - protein, 644 aa, Candida albicans
FQEINKHYQIMSLSTSTSTKPKAPPSTTIALVTSPSSPSLKLFKSKRKIKNLKNLTIIGPLSEQQPGKNVKVITTTTTTTTTSPSSFSSSSSLMSPITSQTPNIPKTPKTPKHSKHASSGTSSIIADIQSISLPSITKSLLPNSSSSSSTSTPTSLAKTLSMPMLFNQEKHSKFPQLEENNNNKEEEEEEEEKEGGLIDLTNKSIILITKYDFISDDKDQLNIKAKQFLKLLQKLGNGWLLVHDLYDKSKLGLIPASYVDIALNDPLEPIKLTWLYEYSKQKPLLLLLPPPPSTKQLGIEETLNEPLSPLPPPPSSSPFIMIENNNTSKSLRFEIDQIFYNKSNKSFWYKIKYYDNLNHQIIYLGKFYKDFYQLHDGIISQYNNNNNNNNNNNNANNINNKNTNDLSIKLPPPILRNSLYHSPNVKFDKNLIENSYKLLIRLNDYLNQLINHWPNILNECPKFHDFIYNCNNIIVNNNNNNKGTTPTTIITNETIIKSFYPNSIMINKNIHDNSVTFSKTAPLPKLSTITTKQMSNNIRPTSINISTTKTPTTTSTTNKPVIASPTTNSNRIFRLPDQYINNSTYIDQLSKKIRDNTTINSTSTTTTTAKANNTKNLDNLSTIVHSESDKSLFSIHHGLEGPRR

SEQ ID NO: 25442 - protein, 64 aa, Candida albicans
FSFGLCDYNFCILWGFDKSTSLHVFKLHSTTYGGIKIGQITSYIEQPITITFFFFGSYQLMSKI

SEQ ID NO: 25443 - protein, 72 aa, Candida albicans
FFRFYLILLILLFEKKENVTSKKKKNEYNKCKYKMKPSYSELIIDIEFPDPDQMKTYNIYEKQKTKEQSNNK

SEQ ID NO: 25444 - protein, 159 aa, Candida albicans
LNNIGMDNVLANDVGVDVDDDDEEFGNNDFVIDGKDIDCISAIIDDVPLLACFECFGVFGVLGIFGVCDVIGDINDDDDEKEEGDVVVVVVVVVITLTFLPGCCSLNGPIIVKFLRFFIFLLDLNNFNDGEDGDVTSAIVVDGGAFGFVDVDVDNDMIW

SEQ ID NO: 25445 - protein, 154 aa, Candida albicans
DITAFKLYNNFEFNSNPFCGVLLLLLLDKSVVTVTVPVVNVSDSYFALSKPVELVDESDECGDDIGDVDEEDGDTGSSSSSSSRFPSDFLPIGPFLWEFSDMKCSSCFLNGNLASIFISLGSTILCDQLILLRQKTLFGFFTIHLISWIKYCID

SEQ ID NO: 25446 - protein, 70 aa, Candida albicans
FDVNCCIGHSHSVRLDDNFFNELKASVKEALSINATIPQFLGNLLACSSTASTKSKSDVSLVKLIHMSSG

SEQ ID NO: 25447 - protein, 86 aa, Candida albicans
LLGIKQDLISPKILYRINVKFLGVLPMGESLPSNNKNNNDGGGGGSVQQKLKEQSQTRRWGEGGERGGGRTEAHAYMRVCHARESD

SEQ ID NO: 25448 - protein, 72 aa, Candida albicans
PFSKDWMYSFFSSSAWMCTLVTAPQTTATIGSGLSPIHFLVINSSNQPVVIGIYLKICEFLTNWNNYSTVNS

SEQ ID NO: 25449 - protein, 71 aa, Candida albicans
RMKSNAELYLDTPCVAEFAYWKFALLATLWNGIAKRIAKKKKKKKGGGENDVFNNLMEIIYKQVFRTTIGF

SEQ ID NO: 25450 - protein, 95 aa, Candida albicans
LLSLVRYYWLDRIIFFFSSSSSSSSSSHYTEATPPEKQQLLKIQKSHNNNNNNNNRRMIINVGKYIYTPISSLTPPAPLYFISRKFYFKPNQIIR

SEQ ID NO: 25451 - protein, 294 aa, Candida albicans
FATSPYPTPIHTFAEMLHSQSISNMNNTKSSSSFLKSLRSKKSDTNIKNGSTKSKRNSRPLSASISSFNLNISLPILTSQKSFIEDNKENQNGVKTLRPRSSAPILAEHQSKNLSSQTLSRPPLSSKRYSSYYSTSSQISPQTVQSQIDSIFDESSVLYVDLENEENLSSSNSSLSSIVNQDHTYLQNKIHRSINSYNLSDFVNRMNSNNNNDNNANVEKNKSFELDQLAQWNARLTGINNVNNNVGEFETEFKLMESILVLSVTNKSSLAGVSARKNILAVDDYTYVFKSEDT

SEQ ID NO: 25452 - protein, 83 aa, Candida albicans
TFFGPKKIQTPITYQEASNQLPDHHYTFKSHWSITILEYCLIKETIKYYRYSLHHVIISLVWKSGKFYKKKFDAFGIAETSAQ

SEQ ID NO: 25453 - protein, 91 aa, Candida albicans
FICNPTNTSYKNVLVIGWKQHFYRLKMHNMALNFSSWVLYNLRKSNICFYDTVLLYKNMTFIKISVRSEKVDHLQTHQVGLRGEMVIAFDF

SEQ ID NO: 25454 - protein, 377 aa, Candida albicans
IKLGDIMDVSYSFTPLTGYKDSLVNQNVKLPLNYPTIDNHNPKKSTTPNNEFHKKIATTGKIINLPKQSIVPAVSISVYNDMKTIVLTPMEFQLSSIGFQFQNLIIDLPHSIISTNCITFYYHQDHILIDLIDQNYLFITLKIAVDRFILGGQQLTLDNFEEWGYISVPYSFELRSSPFLLKCLDNLNLIVSLKDGGLLHFKRDEELGEINVFNFQEQGTLIPFLGFFGSGKQKDVVLDGVSSNSIVDALQIGGSGVVITLSVNKVLKLWNLDGHQNLSSLTIASDDNTWLPTIPSKYLKSYEQEDGKTIITLFINTKSGDSSKSMFVFKSFELESSNLHDLSDLSFQPELPNSLLFSSDVFYHESNFQNTIWFIQD

SEQ ID NO: 25455 - protein, 383 aa, Candida albicans
  UNSURE (378),(383): Identity of amino acid sequences at the above locations are unknown.
GSAHISLKYYILWKSQTSSILVEYIINPVNVPILSIEISHLNGIEFDENIYAYHDAEYYMDRIFDSGNYDSLIVLTSIKILSQHWEIDNDMVVTSQSIRQLAIDTINSKAESGTIKNYWFKLQSLCEEFKNLSQETLSLSVFDNQVLTLNVNGHGIFRKSAFFESFANQKLNSADGKLMLIFNKFETFISRKSYHKLHEELLQLRKISANDITNLFTKHIEGKISTDEIQTILKDLEQIPGIVEIVKSLIGSSGFELIVDANSISSKELGAFHKISTVMIFKNIMETHKTLLLDLVVLFLTCETNDQIVEFVNQIRATLVQYDVMEVVFTTCLNKGEVETKNMGQVQNSIFWSSVVATHSQLKRLIESLQLNDGYEYXYNNVX

SEQ ID NO: 25456 - protein, 88 aa, Candida albicans
KKNQFSSDLKRNVTAGTIISSYHSNHQLLINYITLVNCVDSKGKRGDLVAVNVVTLKNKEGGVLTSRLFQPLKVLLYSVWAHTHGYFS

SEQ ID NO: 25457 - protein, 111 aa, Candida albicans
YSHYFQAEQKETKKETKVVFSSSSKYFTPPSFFDTQFLGVRTNLTNPTHLNSETNDRKKISTPIFVMLFGATSSICKHIQRKPGKVEMEYTPRVSNSTTDVIFIFCYLIST

SEQ ID NO: 25458 - protein, 66 aa, Candida albicans
  UNSURE (1),(19),(38): Identity of amino acid sequences at the above locations are unknown.
XVWCYNLITVVTNFSLVHXVATSHPTNKFLYQLYIKFXFSVFGCFDHKLILTVLSFVDFQIWFEKQ

SEQ ID NO: 25459 - protein, 85 aa, Candida albicans
VRTKLIFFLEGCPSISTHKNTKHIHIFSYIRLMWGKCHNPLMAITTPLSKKVYIYILAMFSSFLSLLIIYCIPLNHSYLFKLPLQ

SEQ ID NO: 25460 - protein, 63 aa, Candida albicans
TLHKISMNQATGHYHGLIPLTALETYNRKETDGLGHVSTVKRNKKIGRTKKRVSILALNINQL

SEQ ID NO: 25461 - protein, 294 aa, Candida albicans
LIFLWLRMESILHKYRDLKFRVNHLLVAYRQRYYSTHKNPRVIQSRVQNQQLLSLRTFPKDPYLTGSDKPFLHLSKEYEETESQYLDNSDERDYTLFEYTNDMSLKAHDSATHGKSYSEPNFGEGYFLTFRLELPTNPSSDEQHQEITQFDPTQPAEQCEPLLDMLITTDEYLSGSSISPVSFPCTCHCHTFEKIAPQSSTNKRNHNVKEKLYDFVVNNFSKVTGQGNDTVATISSNIETFTPLDIQATDSIETVPDKTDPTKGTDRIWKLVLNDVSLSAARLSTGKFQYSSSK

SEQ ID NO: 25462 - protein, 202 aa, Candida albicans
RSSRHTRCSSKSSDQGHIVLLLIVWSFSVQREKKNFLFLKSSGGTSRAVTIKTKTLIINTKVTNSLNMAFELPQLDSELRTELEVIIQNKTFDESKSQLQWNDGILPKLITRLNELAALSKDGDRFGNPKGIDFISEIEATNETITHHLAEQMSLSPPFTIHRLAELIVDPNSQGYTITNNDQLFKYFNSLKKVCIVSSRIS

SEQ ID NO: 25463 - protein, 64 aa, Candida albicans
NDISKVKKKKIKEKSQLEMDLDLNLRLSLKIKPRIANKPANEATRKNSIEETTTRSSTRHQVIC

SEQ ID NO: 25464 - protein, 68 aa, Candida albicans
LKKLIICITRAISSDVNYELCQNYISANQNTSKKVLSGTNGPRKNKKQLKYFFLCCVYVRFDANRLIK

SEQ ID NO: 25465 - protein, 65 aa, Candida albicans
FFETRWYGWSNIPLIFVRNDLRNRSCKIQANHVHYYLVVLARANGTLSSNTDLQINVLLLKNKFK

SEQ ID NO: 25466 - protein, 82 aa, Candida albicans
YSLSRIGNRRVGDASFILITLFKFCVAWHQKQKNLNRCTKKLLGFIQSQYLPFINVIQMIIDNWRKEINFYYNDIANWFFFG

SEQ ID NO: 25467 - protein, 60 aa, Candida albicans
RRLINLESITNCLQLKSDNSKIIQPFHTKILSSIHVDVPPKTYTQALIELIGTDSSLRSL

SEQ ID NO: 25468 - protein, 89 aa, Candida albicans
IIYNYFLFLKFQFLIVIIIVSFIFIRKGITNNQIIGFRIVFFFDFHTPIVLFKRNLRTSPYYQLIRLLFHQSVYNLEDQGIHQSIHYLK

SEQ ID NO: 25469 - protein, 61 aa, Candida albicans
QRKIEGKKKINLNRFKLSENFKLRDEKERKLINPIPKKNPQQLTICVLLLLLRRPLVFVVF

SEQ ID NO: 25470 - protein, 82 aa, Candida albicans
FYFISSRGLMFRVFYLFSSWWSNTTTTMLKKIFLRKLRLCNHCTCIKNLNASSVTHKYLRTKKNKKQQLFQLVAIRKVGKSH

SEQ ID NO: 25471 - protein, 65 aa, Candida albicans
FQVIKRNKNREFSLLNIGDEKSKKKTFHPCIKLKLQRSKNMLKKTLNKKNFAFDLSFSLFSFVLK

SEQ ID NO: 25472 - protein, 77 aa, Candida albicans
EKYEKRKEKKEKKEKQEPQEQQGKGKREINLYLYVVEGKRGGAGRGTEKKSQREKSITYDDFAFLDLDFVSIYYFFV

SEQ ID NO: 25473 - protein, 65 aa, Candida albicans
FVLLLETWWLKIKLCTVSRIELIIIKKSQINYSVSQHCKVITISMCQSISKVRRGGGTRAMTPLV

SEQ ID NO: 25474 - protein, 63 aa, Candida albicans
LVNTRITAVMKCGVHGRFNTHNLLLSSFPHFCFVSGKICARLKKTRSRRYRLISNSPSINDIN

SEQ ID NO: 25475 - protein, 70 aa, Candida albicans
LQIRKVSVVMTHGKVKVFTLKKTKKSINHNLSDKYKNYTTLGLLIINNSSLTSYNSDLTLGYNLCMLCKN

SEQ ID NO: 25476 - protein, 60 aa, Candida albicans
LQGTPNNTKSSLANRLFNCSRPLYWKENPHLEATLTIKTTLPRRFLNGNGDFRLSKGVKS

SEQ ID NO: 25477 - protein, 69 aa, Candida albicans
RSRKLKIKKIKKPITISLAAYTIWDGKYFRLFLNDYFRYDKKKCLPQNQIKSSECKLKCNKNLYSKNTL

SEQ ID NO: 25478 - protein, 62 aa, Candida albicans
LHYTISIHTLIRVNEFSMIGQVFISNNSVFIFLPRKGSPNCKLIANNLAFKKPSHGEYNNNT

SEQ ID NO: 25479 - protein, 67 aa, Candida albicans
YSKTTRPRPRPRRENEGTKSKQIKNQNKKKKDFWRLKLKKKKSFTTTTSISTTTTTPLSSPGGGRSE

SEQ ID NO: 25480 - protein, 70 aa, Candida albicans
IVRCLDPTSIYLSKTCIKKKQLKKYESLDFFVQDFIDIAGADTFYKIFFKVGFRTCVESVAPNEIINQRQ

SEQ ID NO: 25481 - protein, 64 aa, Candida albicans
GKRMSNTGSPHERTLLATARLKSAPDPAVPLIKTNNPNNIPKTAANIVALMGTLILGLTYLTKL

SEQ ID NO: 25482 - protein, 75 aa, Candida albicans
THMNSNLNCSNNIRSSTIIIIIIIITVAITVAITVTITVTITVTITVTVTATVIVTVTVTVTSTITMIVIMFMIN

SEQ ID NO: 25483 - protein, 97 aa, Candida albicans
FEKPFDNQLEWSCVIVKKTEQLGFFFPTYARPKKKLYFFNSIQFKGQKKNHHLTTTTHYNSSSIHSISLYQSQTNIQSTVIIIIKNKKKDLEYSLLV

SEQ ID NO: 25484 - protein, 64 aa, Candida albicans
LIVGLNMIYFNKVIDPTPIFICFSRYNIIHQNIIPLSMASTSKSYRGGGGGGEGGVPFLKDSTI

SEQ ID NO: 25485 - protein, 232 aa, Candida albicans
GRRKLWDRKNNDNNLDSDTQYPIEQVSAPTTSDEPDNQRVDFEELMIKISGFQENFVNKLPYTNVKLSRTQQRQLDYKQLYEYESTDIENGSDLVCYDWKIQNETILSQYTSIRLRFSSKQTTSKRQNKQHVENHMGVLGFIDRYRNNASGNTPTRNSDTSFDDVNAKLNDVWTQEFSRLFAHNANATTVQKDTSTTSNTVPDIEDKNIYEDRTVNMSNLAKGVKLNGLLKI

SEQ ID NO: 25486 - protein, 64 aa, Candida albicans
ITIRNLSVTTCDQDLHWANLNPTFYPVLSLEHTRKKKKISLNNGHTRNSIFARKNNNRFSSVLQ

SEQ ID NO: 25487 - protein, 85 aa, Candida albicans
HGLLIKTIYWGSCGNYLNYFFIKIKITINNSSRNIFKGNQIPNQTQLADSKLIKPNMYSNYKVSYNNSLNLYSSLASSISCQLPI

SEQ ID NO: 25488 - protein, 75 aa, Candida albicans
NNQSISYINLLILRFLAVFIALTSSPLSLVGSLTYKSSTIYNSILKYETRPKLYKPKVLKKIPQENFIHSIEQLY

SEQ ID NO: 25489 - protein, 77 aa, Candida albicans
TSGLESKIYYQLFKLLVSYYHLSLNFNLFNCCLSSWFNNGQNLVIAKYKLKAAGMRINEILVNCGYSSHVESINARK

SEQ ID NO: 25490 - protein, 74 aa, Candida albicans
NNCCWPLPYLMQEQENHYFLAFILSTWELYPQLTNISFILIPAAFSLYFAMTKFWPLLNQEDKQQLNKLKFRDR

SEQ ID NO: 25491 - protein, 65 aa, Candida albicans
RSLIKVGVKTHIFVTNISSAYLLVPPYIQVLTNIYVTKGQEKKNFIPTKQTTNKQPMRWKPFTYK

SEQ ID NO: 25492 - protein, 64 aa, Candida albicans
FPSTSFIDINGAVNRMQFRIKERKKRREKQSKEKKNFIVKKTIYTTKIDLVGACRFSQKKNGRG

SEQ ID NO: 25493 - protein, 134 aa, Candida albicans
RRRRRRGSSSNNPNLNAMCLLSQENKVGAGKKKRNYHHQFCYIPTYMVVITNNMTDAFDLNYLFINQLAFTFNKYISSSSSNIPKSSISNTAKQCLDYMKQYEIIHPIAETLIDYLSKEDRCLHHGAGKSRDCA

SEQ ID NO: 25494 - protein, 60 aa, Candida albicans
KLVICDISGVTTRHSGDKSESVKNNEGEKKTSQIFLLPPPLSTTSSILLSLLFKFPIQLP

SEQ ID NO: 25495 - protein, 77 aa, Candida albicans
FRKTLLNIFFFFYQFRDDGMNDDDDDDDDLQKIFLASVHTHLYKQIQSSRCQRLLLSLPKYTRNSLKKIEVDEKYIL

SEQ ID NO: 25496 - protein, 378 aa, Candida albicans
  UNSURE (34): Identity of amino acid sequences at the above locations are unknown.
VPKLEDTTSKKVFAELSNKTVEKKSENESSSSSXINKSDTSKKREESKASSEILTKPKHHFRRAENKNPDNGGRNKDKENLLSLLSNSNSLPQQLFKIQATVPQTTAIVVDPGNDTVPSNIPLDKEAIDAAKSEKETNKYEHQSIDATSNEQAVSLSEDSFPMATTIMMSLLPRKRKWPSSLKSLFCINSIVESNKIEYEESGVCDLQKLPEISTQYRLKEINGFGVLSTTQSLTPANQQIYQKLVATGLELSLEFCRYLEILNERSMKQDIKDSFLIQFGRIHSGLPFTTNHTNSDATKEELLHIGELFDEVFNNNNTVWIANKFEYNSFGRKFRKAIVETLESDYQIRISHRRDLFPRQMIAASLFQWKKNIHLPE

SEQ ID NO: 25497 - protein, 93 aa, Candida albicans
VKIETERRLIILATETTSISIKLGLFDYNKRLKEILFSKHQKRKIILSLFGGEIGKQLLTVVTFYFNYVFHVPQFRNLIIVSLFSCVIKGHEK

SEQ ID NO: 25498 - protein, 124 aa, Candida albicans
DLKKSLDNNGSFGVAYSKVDPYDMITITNIQLLTIKTIFVSIRHILKFCFIMYGYYSKWLKFLVRYHYYHFHCGRSFIYLSIREILYNGLHLAIYFLWCRFKNHKSYRWCSTNKVYVINELYMY

SEQ ID NO: 25499 - protein, 325 aa, Candida albicans
IYAKIYLIAVTSWKNILHDNDDNYELFEIVGDLLGLIIKFIDVSKHQEILDQLNQTFITNNNDDDDDEETNHQGPFKYPLNLLIEPNNYINVYNKILSSIDKTCVFKQDVDQQVIESIINLIYKIGSDDEYLRLQYLQTLCLLINKFTNNADFIESKLKFLEKVEEQDFPITKKDFISFEIFIWILKGLIVKLDKLGINYLNQLLELFVITENYKLKQLIGKSLQILFIDLKIFTNERITTTDNTNSTNGGIKSSSQLISKVKNLQVKSLYKQHIFVIILPYLINDSNENFTNDADFNLKFNSLSLIIENLSINGNNNILINQLI

SEQ ID NO: 25500 - protein, 82 aa, Candida albicans
SFIQGSHNHSWIVFDVPSVSLIPAHDACTLTPHDEHINISYNDADLAALLSCSRQIQQFLSDGSHGSSMDEDGTVTFVNRLL

SEQ ID NO: 25501 - protein, 239 aa, Candida albicans
ATMEFYLIPPVSYQTQEKLKKKTKRTKEPSSSSSGSNSSSSSLSRDLLALRRGSTSASSFTSNSIFSSATSTKSRKSSCCSIETASTATTTTTTNKSKTSSNAIPMPISSASLTQPRSLSRKPTNSSDSHSINSLKTNSSLKISSTSRTSTSKKHYNYESNTTMNEILSKPKLKKKSLRSVFKNLSLNNEKENSGHKDHGYDYPTDDDDNDTLDNLDLNTIYSDANSIFSRRKTPVALK

SEQ ID NO: 25502 - protein, 98 aa, Candida albicans
VNDAEEIGIGIAFDDVFDLFVVVVVVAVEAVSIEQQDDFLDFVDVALENIEFEVKEEADVEPLLKARRSRDKELELELEPEDDDDGSLVLLVFFFNFS

SEQ ID NO: 25503 - protein, 92 aa, Candida albicans
  UNSURE (17),(21): Identity of amino acid sequences at the above locations are unknown.
RGLFISIFQEYTHLIEXASLXCSQLLRKKKTLHNNDLMELNFRISMYNVANDNNRLKRFVLRRASFSPKFFTALYDLLTKNNQHIIVIVRQC

SEQ ID NO: 25504 - protein, 69 aa, Candida albicans
  UNSURE (11): Identity of amino acid sequences at the above locations are unknown.
LNFGINFHEKXNPKPNLYLFAYVFPQKNTLTEQQILFTYIINIKLHLPNCPSAFNLKLSLLNCKLTLKR

SEQ ID NO: 25505 - protein, 97 aa, Candida albicans
IHNMQPYSRSGGTRRCFYEFQSWMSCVTSADTTSVKQCKPVFEDYEECLHGLKEKEKVRLMVQQLKDNETSKNGVTASELYKASNTIYENLDLIKRE

SEQ ID NO: 25506 - protein, 209 aa, Candida albicans
GTGATSGSMLSNKTVNSNDQNSSIPSAQQQANNNINLATRAALLRLSLLQNLVNLNKRSRPDSESEESDDGEDEEDEDHDEPERVRKKSKLIASTPIPKPIMTPLSGNGNKLRSNLIPWSSKAKPIIPKPIPAPDPTNENDEVKNKNPREGAQVIDKLKNRLLSSLTDLVGKGLPDVKDKKTVAKKPLTIFGDSSDSEGHDDSDSSDSD

SEQ ID NO: 25507 - protein, 500 aa, Candida albicans
MITTRIRPIMNNTSTHTNTKTSTTILAKRSATATTATTSIPKQSSMSGQSKHAILIPSALNSLLHTDKQIKYHFYSLGGDFIRLASYRRFKQLFQVGGGSLVKQFVFDLSTFLKEELNDINSLRHHQLKNFLTCNKTILEKEKSMTLCDHHFGLKNWLYIIFGYMLQNYNEQEVNNCLDQLVSMYLEARSNRFSINDIRIIRDERDQFILSTFEQYLLDVPVRNDLLYNDNGDNKDVNYIILSNIKHHKHSNKNATIASNKANHTTNRINLPKLPKIKDKSLLVKSLMHKEFYRVLLDPNHYFGKKMLGRNYSLDPQDYSLIRKELSILDGLGDLFLAQETSKLIYELICQKNHININSSTTYQLLKIMLATNTLMAKLTKAYNLYQGLDDSIINKRIAKEWLPFTILGETPPHSESSDWQSKDEIRIYEEEFLGDFFESYMAALLIEQPEVAKSFIREIYHRILMVMTETLPPDITYQTWTSNILGRNIYRKKSESIQC

SEQ ID NO: 25508 - protein, 78 aa, Candida albicans
  UNSURE (66): Identity of amino acid sequences at the above locations are unknown.
TQLQKEKISGGGIGSGVGNGQKNFSRRYAYSLEASLTVKEQYKRITFSVVVFLVVVISVFYEFPSXHHAMAIQAYMWG

SEQ ID NO: 25509 - protein, 61 aa, Candida albicans
LLICVSLLTFWMYDYDLAKTKHIRQCVLVAELTHTILNEIGQNYLSFCSDLFCFYEQICLI

SEQ ID NO: 25510 - protein, 114 aa, Candida albicans
  UNSURE (16),(108): Identity of amino acid sequences at the above locations are unknown.
VHQEMGFVQFTKEFHXAQFSNPEAPSNDQLVTPKEQYNIFISQPPHGTETGVQSPKHPYFMQDERVPPTEEVQAPAPVPASASKPQNSYIETTPLAPANPPKTSVSNXGATSPG

SEQ ID NO: 25511 - protein, 77 aa, Candida albicans
YGLLELFNFYLINFHFLLKEKEGNLENSNFFFFLDFILLLFVYLEKKKPIPRFFLATTISYNMDEPRLVGWLVDWLY

SEQ ID NO: 25512 - protein, 630 aa, Candida albicans
IVRDRKRFLYNDNLSNSHMVQKQYRFAPKSIFTFVFLCFVAIVVIISTSSLVQVEESLDPIEVSDEIKKHDRKVVIFPSNFQSANNKLADFLTEAFGQRLNKGDIVYKNRDTYELPQTVYTWNTIDLFQSIGEKDNLKCEKIPLNFEISKIYNKNADLYKILRDFKNENSFYYKEVSVFFPDLGKQLRERTIEKHWFQLIGSSVWLEQYGVHLMISRVIYTKTGNKVQPVISLSYVQAFDRNWTELKNVTLVVPDSGKAKFKTVSYPSFIPIPVYHNVNQQRGKFYGVEDPRIMLVKNKEGYEEPLIVYNSFNRSPPNANYLEEIKNLVKLDTYRSIFMAWIWRTQLGKSNVGLLLPDLATTDDHKYVKVKELSLPNKKRPKTEKNWTPFVIYEDQKKQGYDSHLYFIYLFQDLSILKCSLWDAGNCIWEYRMNNKKTKISELRGGTELMNVNQLLDKYNFAGLETVKDQFKGKEVWISFARAALSKCGCGLKMYRPNFTVLVKQGGRFQLSFVSSYMDFGVPILPWAKGKGLCNGKNLLIPNGISNWVLAKDEGGGFQDYMTLSLSRSDSTVDIIHMKGILKSILSEYLLQTNRDVLNNNAIHCALLESESYCKSYAENYRAHLKRWQN

SEQ ID NO: 25513 - protein, 63 aa, Candida albicans
NRTVGNLLGISSLNIDFYIQRKQMEVFSVYALASLLFFCLYNFFCIIYTMTDEEERRRDVTWL

SEQ ID NO: 25514 - protein, 73 aa, Candida albicans
MLFYKNDTICSVCYDEFEDVSYIYHGSIDDNKKYCCPDNGKEIILRTLGKYDASGALPDYTKHPHKKNSNVLG

SEQ ID NO: 25515 - protein, 133 aa, Candida albicans
LRTKLVWFNFKMNNYFTKYIPNIRLSNTGDSDDHTIGNSTNSLPHINYIIIFNPTFVSPKAESDEELIKPIIVFLQGKDLPQSQFSQIEQLKLIGLLRGIESLGESFSNSTTSTTTGKKPTILKSLDASTVMI

SEQ ID NO: 25516 - protein, 69 aa, Candida albicans
FNPYLSSEAKLDTFPAAATAAAAVDDDVVSLNLNTIIGFISLTLRTKFRLIFSRYIPLTPMNLSMMSNS

SEQ ID NO: 25517 - protein, 498 aa, Candida albicans
  UNSURE (12),(23),(50),(102): Identity of amino acid sequences at the above locations are unknown.
NPFSNLLLLPNXCSSDNLKFLEXYFNSILLYYYLKAMFNSKVKPEPVKKXTHISDSSFISYCPLTSDGSVVSFPVGQSLGIKGASDTHEGRFAKLTNFYFKXNHLSKVHAKIRYDQQQGFYIQDANSTFGTVLNNEKVLIAGVEHLLNTNDTVGLIMSKTSLQIKKITQEFVSANSTDKEIRSIPISKFDNPTIVLNFRIEIKDSVLKLVPIEREEARATIDAKTGLKSILTDHTKSLINVEEIPDDTESSDNEVEVVDIDIVSNPVTKIDSVCSNGHISDDQIIEIDISDDELVSGKQTHSKENKITESDCIGDGKTQKTLSRSASVEELTPTNRVESHASKMIVEVPSSEYEDDESDVNEILEKTEFNWKEQVSDEVSDNDSSGESLDSELSNDGSSDESSDSVTVNDIKNKQDEISISSDESELSERECGDCDQTEGDNSNSGNHEPFYPVCYRLWKDDRGSKYYNLLDKHDDADSDSENVLDTESTFLVAIAMR

SEQ ID NO: 25518 - protein, 87 aa, Candida albicans
  UNSURE (45),(48),(49),(57),(60),(84): Identity of amino acid sequences at the above locations are unknown.
LQIGPSLQVLPYSVGCAYTLFVLHVSMNSGISVVAAVAEKSVGDXSVXXAVIVTVDXYSXFQFAVAVLGTVVEKHFEYSSWVYXLYL

SEQ ID NO: 25519 - protein, 141 aa, Candida albicans
FRKCTGYRVHLFGSNCDEVDDIKIAEDNKLVDSSSIDLRDDFDEITSQDQSSFNEISFPRNFCLSRKRRFDELDSFDEFGRHTPIEYSDCEFSNQPPRKKHASTESKWKTITKEVGKGLFYVFATIAALGIYGSSIANEES

SEQ ID NO: 25520 - protein, 271 aa, Candida albicans
  UNSURE (38),(67),(91),(94),(101),(102),(105): Identity of amino acid sequences at the above locations are unknown.
PKRSFPCSDSQRQRGRRDHNITGQEKFKQSLAQQSQSXTKLQSNSVQGQIIVGSIVVNGSNVTSTAXTPTMNIQSAFQQLSQALQPQIGSXNNXLQSQSQXXRQXSPQQTFQQQQQQQIFQNSLTREEQKVYKHIQQNMVTLAMMGQSGVTHTGQQLTPQQIQQAIQQAKNLRQQLFQRFPLYFQRMKQLQLIHQKRRLQQQQQQQQQQQQQQASNSSGGNQNNSSNQAAPQTQQFNQALPSTSEQSKPVTTSPEVKKKRTYQKKKNAPAN

SEQ ID NO: 25521 - protein, 119 aa, Candida albicans
DDDSWFLWLSILICRLLLFARLECECESECLRECECDWEWVCCSGAGVFSFETGISMVRNCILISKVSEDILDFLPNIDPAPKLWQTRPGTKHDSLEYNNFEITPLATKGSSGCSLISW

SEQ ID NO: 25522 - protein, 77 aa, Candida albicans
KELLNQYQMKLFINEKRKKEDKKESKKKKQLFIVVVIFFFGGGLALLDGYSGDRIGSISKRINLLPKSLKKRKKKQL

SEQ ID NO: 25523 - protein, 215 aa, Candida albicans
YSSSVRLMQIKILYSIYNQPNVYLSRSENTLPVKVVQIPLGMNEDELITLGGLELQDCVKQVVRSAPDTFNLNFRDFEVYYQDISEQPDEPFVANGVISKLLYSNESCLVPGRVCQSLGAGSIFGKKSKMSSETLEIRMQLRTIEIPVSKEKTPAPEQQTHSQSHSHSRKHSLSHSHSSLAKRSNLQINIESQRNHESSSHYESNSPAEAQSSPW

SEQ ID NO: 25524 - protein, 474 aa, Candida albicans
APKGILISYITVSRGKIDFDGLLQKGILTRDMIERKRHLQTMGDGKDYSSVSDFINSIIDITTGDIKVNPIKNLINNPDDQSPVERNVHDLAAIEEFLASDNLQNKKIRIGEPKPFPQTKDDIVDVKRLATTGFYQIISLKNEKEANQKIQEYISAFIEYPHYIIYMHYWLKRKEFWLKGCSVNQSGIDFTSNLVASWHSILNEKVLNKSRMARADIIIYTLFYEVLPYYENKDGVSGDNTNKPNLIQASKRNKDIVDALTMEEIEKRVEIKRSKILVQSSRQEDIFYEIKKDDGNKYSCNCENYRPIKLCTHVYIVARFLSVHPPKRTSNKRKAATTETINKLQKIAPAKNNETHEYQGQSVQPEYHASLTEDHSFPLTPLTYNYDSNSTDSQFNSFNQPTTEIDFPDINEPDGHIPLITKEEINKDIAEAIKVLKDTSKYVRENGSYEELLKFSNHTRDFTLNVKKLLLNNP

SEQ ID NO: 25525 - protein, 81 aa, Candida albicans
HYTLFLSPHYSTSRKHTINTAVPKLDSEILRQVINDSLRIENVTLNDTASSIIPNQTPEMEQLIEEEASLSISLAKNDESF

SEQ ID NO: 25526 - protein, 145 aa, Candida albicans
FPVHENMNCLIKDFLKLPLIREELIDAHPHFIALLRRPHLDSNFGQRIFNGDYLKKNFDRQEFENNRHMLNSNYKFKPKPRPKPKSSPEPEPEPEPEPEPEPKVKEISLDNIEYASFGNANASVRPHSGARSHGATNSWCKNVCC

SEQ ID NO: 25527 - protein, 311 aa, Candida albicans
YSPTFDEFKLYLKTTNKYFRWSMNRVKDHIYMKCEKGKKYYETKTKTKKTGCPAGIKLRTKNDKVQMEYCFHHNHSFIDHDDTVSATVRDPVRTWLIKQALQGRDWAWVNSQRSKVNFGTNIASLDHSLKFNCQLYHRIRQKLGIFTGRVSSKLEESLKEYQDILSQNGYVKFWLNLNENNDNSKPRTWGFAFATDYMLTKLQQYGNTIFIDSTSNIGKSDKITERVFLYTVMVLDTRIGQPVPIAWLLTHTQGSYPLYLLLHDLNTRHGLNPSLICIDCADIERKAIRAAFPNEKESEVSYCFYPLTLST

SEQ ID NO: 25528 - protein, 74 aa, Candida albicans
GDRSSMKLQILFHWETLLEWLFSQCLHSQYRSKKDLTRALYSSHEVVNKVGTTPEYVLKAKQLELVDRFWYLIP

SEQ ID NO: 25529 - protein, 60 aa, Candida albicans
RCILFQTQYHCCLNFPFVLQNNQLKSTKLISCSSSNTRLTCYKDVKIFGVEKIASRLLHF

SEQ ID NO: 25530 - protein, 60 aa, Candida albicans
FATINFSPFMTLYDSLYKINDLETNTKQDNVQSKGSSARGSHSVAINQRLRYSKAIANEH

SEQ ID NO: 25531 - protein, 80 aa, Candida albicans
FFFFVFILQYLTFQHNHLVKPLFELKRRRIKNKIILLMMDNLNQDPNSGVSQHNNQHQLQFSHNPSLSNTHQHNSADFGT

SEQ ID NO: 25532 - protein, 119 aa, Candida albicans
  UNSURE (10),(91): Identity of amino acid sequences at the above locations are unknown.
NCINLSDLRXCVVSTRKLQLNFVAHSFNLLLILLRKKVPPFSSCNKENGFIQNWQSTIKHVLVCINYFLLNVFLGVIVWFNPNPRTEKHFXMKVWCLCYSRRIHLFPKILWNKPFKTSY

SEQ ID NO: 25533 - protein, 68 aa, Candida albicans
RAGHVGFTVSVKGGFVLLFNLATKFLIKEFFFFVHCRYYDEMNSETFFFAVLDNESSHSIGKSFMKSD

SEQ ID NO: 25534 - protein, 68 aa, Candida albicans
LVPVYKLKLTSLNFQYNEIPINRPKMKKNIKKKQTDLCLTKLSYTYRPLHNTTAIFFYNTFLTTCSPT

SEQ ID NO: 25535 - protein, 67 aa, Candida albicans
EKKKKNRLHDVYYLFTRFLKTRTLVSQTTLFTSYDLRQTLFHLGYVFVFSYQLSGFFHCFYSYPSIL

SEQ ID NO: 25536 - protein, 78 aa, Candida albicans
YKKKRKERYLGYLLYRDRVSIDTFSGRKLHSLCFLLITNYHLSCTRTNSHEYSVYTNTYCQLMVRNFICLNQNQSHII

SEQ ID NO: 25537 - protein, 62 aa, Candida albicans
PIIQRKEKGKKLFLLNKESIYVNVHLNDVTLILVQTNKVPHHKLAISVCIHGIFVRISPSTR

SEQ ID NO: 25538 - protein, 64 aa, Candida albicans
KALAYVARNPRILIISFRVDKSSILVRSSSRSYKFKGEKNFAINSYYQHIWIVKRIFLIQRTHL

SEQ ID NO: 25539 - protein, 60 aa, Candida albicans
HILKLSCIFNSKTSKSYLIFKNYALNKTLTNQYLSRDWLHLLCAIWSSLYNVCINPPIGA

SEQ ID NO: 25540 - protein, 148 aa, Candida albicans
LDFLRGEVILIVTPVVRIHLCLTMREEGPLVSTTTSIEPVDYVTINNYKFYSQEYTFTTVEKQYISNCIPDLNSFDKWNGKLITVSNVDHFIRDKRSFEDKDDVFISYAALGNLVQSYDKKSHNDSSMLTTQTFIIHQKGLVGLGTQV

SEQ ID NO: 25541 - protein, 209 aa, Candida albicans
FVDCFFEPSVFFFFHFFYLLTKLVFLTHFYSCCVCTKKTSPFIILFDINHTHTMSLPIPDLRFEQSFISQLNKYAGNKQPDQQKLQPLSSKKYNHIATLTDDDLKLLNEELDIEEEEEIDNYTDKPQPKPLAPITPSIVIYAIIKDQMLMPLLQGFLWTGVLLCVRPLLKLVVRNGQYAGHWVSNLLGLNRLATSRSSSPRGWTDPHLS

SEQ ID NO: 25542 - protein, 68 aa, Candida albicans
CPTHNLLNLSGMDINAAPKFGHLWLNWANTNIGSSISLMKYLSRGLDMESGYKTESNNQKRVRNQKKN

SEQ ID NO: 25543 - protein, 63 aa, Candida albicans
CTHNMNKNGSEKRALLEGKKNEKKKKQKAQKNNQQIIVQVTGTSHRTTFQSEYCTNIDSTLWK

SEQ ID NO: 25544 - protein, 73 aa, Candida albicans
RSCIFRHNSHILKIMHTSLKCVNIPNIINYMCSELVAKLSTQFTLYKPYKFSTFLYFFILAFLLESINTFFII

SEQ ID NO: 25545 - protein, 73 aa, Candida albicans
FARGYASPVGQESDNDPIQVFSSFNKEYDRVQQKLLDKIQSERDHQLNCLSVQHLHRQRRLLDISSCLEQILQ

SEQ ID NO: 25546 - protein, 68 aa, Candida albicans
NQSILFLSFRYIFHLLIDYLSIYQNTTQSRAKKDIRRNFTMQLRAPFSYKSETSTIKPPKKSHPSSIC

SEQ ID NO: 25547 - protein, 401 aa, Candida albicans
NHQKNPIHRQSVNITHQAMLQSTPKSWKDFLKSPKKPTSPTTPPGSVTITPNTTPPSVPCVSPRPAKIPSRDPFQTINPGLDLSFANILNKSLANHETCFICGELLSTVFASERILKLNCGDSTHSECFKAYFKEDIPHARIHGKTITFAKTCRGLNCSGTRNVVVDVNNWHLVSARKLSLIPKRPAPPHPNSVNINALKTTLQNSDIPTRSPSPDPTVSTTTEVDAYEVETVRNQLIKYLLDLCPKINLSRLVLLGNLRVADELSVCVEPLDYFQTRYVYLFENYMVIWNSVDYPVFVPMQNIQISSRGSSILQVRQKDDGLSTLIQSTSSTVVEKWVVAISDAHLQLPAPDITSTIDTSPSDSDSDIDSDEEVIQQALTKNNWADLMIEIDNALLTSDP

SEQ ID NO: 25548 - protein, 119 aa, Candida albicans
HSYYHNHYTMEASNIRIDGTLLQANKNKLVRVMGKCESFDHASNQAIIVCNGTIKLDLSQVTDSPLEIHKNYEIIGKVSGDELKIFVYSVIELSDNLDINAASKLAQYAQKVSELYRYD

SEQ ID NO: 25549 - protein, 60 aa, Candida albicans
ECYTLMTEVIRRLFKNTTRPQVFRMLEFEIFRVLPNSRFIHVQADNEFKPNKVICGNNLC

SEQ ID NO: 25550 - protein, 92 aa, Candida albicans
CLPPVVKTGSTGAELQDNNQPTAGLFGDGNSFGNQGLGGFLAATVDSLTKTIASPIKGILPPRGGSGGNGGTGGSGAAGGVGNLYSGILGGL

SEQ ID NO: 25551 - protein, 78 aa, Candida albicans
SFSLFGYSYQFFKLIQAGFMISFKYFLQLDEWQLQLDKFLSAFSIDSWINLLDLLNILVHTLDHSLQTNLVSISSLIS

SEQ ID NO: 25552 - protein, 87 aa, Candida albicans
AKFNYEINQSKITYPCQVKYYMKCYRILIRKPNCYTKFNYEVNQSKKDYLSLSSEIFYGVLRSFKILRKRSIPSWSEENDQEYEQEY

SEQ ID NO: 25553 - protein, 121 aa, Candida albicans
QIPMLLLAKILQLHTNLTLSISSLGNMSSKKPQEKTNTSTDPNSAIENYHHDKEVMAMHRIEKRFNTLEMESAIQQQQINHMLEKIITYNIILKHIMQLLQEEYKVQEITKLEQSIKELKI

SEQ ID NO: 25554 - protein, 69 aa, Candida albicans
NNLSNSKIFKWYYSIIHFLFHLKIMETISYGLVEDFFITFSGYKLLGIYALKNEWLGNFTRKYEDFWSS

SEQ ID NO: 25555 - protein, 71 aa, Candida albicans
LIDYGKPSVTSILKLMAGSLAARNMIVCSGSDSLKREVSSIVYELQSLVFNNDLVRSNVEEIYLHTESFGW

SEQ ID NO: 25556 - protein, 75 aa, Candida albicans
ISIQNSNKRLKVRMKSSNKRTNEQSVRQKKARFSTLEKFSIIWQQAHDQDYTNLPQNIKQGFLRTTSIIIKVHIY

SEQ ID NO: 25557 - protein, 71 aa, Candida albicans
IPTNVVTNNPTIFTEQVQPMETPVKRIHFHHFLENSCDLLLKLLKREKQKTVATVKNNNIESNKMNLPKVT

SEQ ID NO: 25558 - protein, 71 aa, Candida albicans
  UNSURE (53): Identity of amino acid sequences at the above locations are unknown.
SNLDTFHVALRFRLNIVENTNFHSLEGFFFFSFMVVILIEYTKGKTELTREKXFFFLLQRFDCLFFTQLQT

SEQ ID NO: 25559 - protein, 145 aa, Candida albicans
PSEVLLKFVINALVLPLCSGTIPTILSLRCLFSSSVLEFIGLILNITAVIQSVRAGAMYEIERERGKVVTKTRVDKYIIFFQITSMIFSLLSTICVFILMIICEKALEYIGNKVDRRVLKRNRKIRIGSESIDDYRYRLDRYYSV

SEQ ID NO: 25560 - protein, 107 aa, Candida albicans
LMVHNVLFDPPLPDGQRINVGNNTIIENIYSIYNLAVFKNIFRIYLTFLLIQYILIYVCVPLDDIENRPPIGIISTAYTLIMVCEKKKTTSNRQEFCLKDTNHQRCY

SEQ ID NO: 25561 - protein, 68 aa, Candida albicans
FQCLWLFFIFNSFFVNIFAPKNGTIIEKRFQVFKPLHIVFLIMYRRKSPYQDKITTITESKWQASQGM

SEQ ID NO: 25562 - protein, 278 aa, Candida albicans
  UNSURE (263),(268),(273),(274): Identity of amino acid sequences at the above locations are unknown.
IFSVYFFGNLYHKKSNSQRYQRIKMAYKWGRSMTSCNIKELPLLPPTANTNTNTNINDWQDTSSNISLSEYRERLLRRNMIDDPNDDYSTDVMPLPPMLQTTTYSLLSEDLTTLTTLRPPEIDNENDHLKAPFCEPLHSTNMSIQSPIPSIHSNEEEDFLPDPDLDDAISMSSYTKAQKRKSRYRPVQGSVNVANAPEKNNKTNYRHFNLSESNDKVVPTTHDTATQFDNPFKDPIITKKPKEGLLKKFSLTNLNIHFEGLKXFFSNXADRGXXRIIN

SEQ ID NO: 25563 - protein, 67 aa, Candida albicans
GFENLKAFLNYGAIFWCKNVYKKRIKNEKKPQTLKSINKLDVLHTFAYICQNAVTFRSSRRICLNGI

SEQ ID NO: 25564 - protein, 80 aa, Candida albicans
VNKLTLSSNKKRKQTFWLLIVDMCPCKRLHLKAGHCFISEKNIALELAIVPVSSSYASGSVSLAFFFSYLAMKKLQHERC

SEQ ID NO: 25565 - protein, 62 aa, Candida albicans
TKPLNAYTTTRSLVQLENLFIQLNSVKVSYSLHITIATLVNFYTSTLLAANFMMGPKNLFFG

SEQ ID NO: 25566 - protein, 63 aa, Candida albicans
  UNSURE (4): Identity of amino acid sequences at the above locations are unknown.
SCIXLFKFSSQPNYSIIRVFIENLLGWHSSGIILNRKTLFLNFGRIYCFLFNECVLMRNNPGH

SEQ ID NO: 25567 - protein, 398 aa, Candida albicans
RQSESQNKKNLNTAFEDLDHESLLFQDTPTLCDTTSSIKHLEDEYRPLSKNQLKRLAKKNQKDKKLLELKSLENNTEIFYQELMNTEALILLTIVEEFDFSERIPGWIGKKLNKWFGKNSKFPILCIRFGLLGFHWPFKRSTFYCSATKKPVARGAAVLYAISQWNAQHEKLTVLLDPTYKDVNFEAGITSSGWYKIKLPNSHIIDLRPFQNQTSTDYFKAIKYRTQDNSFKQAHGQVIETNVFNYENCQEIINMNQNISQNRQLSGQSQQLLQPDWEFIYNLGNFSNEKKYRSLLFLKVDNQIIASCVIFRLGDTMTSDIQGLDHAISKKYKAYFVMMQEVIKIGLREGVKFIDFGPTTEEAKVTIGCNVVPLCGSIYPKNKFLGPIIKFAASKVDV

SEQ ID NO: 25568 - protein, 88 aa, Candida albicans
TKLQFLLFGNFLFSLSIVVVDISEKSRFIALSFQSHIDYDVSNQAITFQKKTDINGTSYNPKKIPCHIGLRTIKFLKKIINLFIKLWF

SEQ ID NO: 25569 - protein, 81 aa, Candida albicans
YNKRIPVALKQDPADNYLFYFHLLSTIDALCFIIIQNTIASECFRMDQVAKNGRSIDLYQVPIFLTFHILIDRKGATFIFF

SEQ ID NO: 25570 - protein, 76 aa, Candida albicans
NEIYRQGWKILKNPKGVDRKIWPKQSEHRRKERPFRGDDTIYGCKPRRILIHFPKFIQPMDPVALTTLLALIWKNS

SEQ ID NO: 25571 - protein, 94 aa, Candida albicans
KVICFLLARAVCAVCAGKKKPLALFPFNEILFFNTHGGQLFHLNILQGNYHRTIQVDSNQVELGLSLDVLPFEGQSGLLRLLLIISLKQFETYC

SEQ ID NO: 25572 - protein, 75 aa, Candida albicans
CLRFNDHDHQHLATYTTTIIVVVLSFPLLLLNIYIKKKELSRFETNYEIDIKHYFILFYFIIIIMNLYLYGQLSI

SEQ ID NO: 25573 - protein, 68 aa, Candida albicans
RVNNFVVIYTYILLIDIPESDSFLSFFNILILYYYNIHYEHTAKRIRENMQHTIHGHFAFFSLQIIKK

SEQ ID NO: 25574 - protein, 61 aa, Candida albicans
IELFFSIFNIQYSIFNIQYSIFHTLFSGVLQFIEVNTSTTTTTIIEIFIIYIQLATKNLNF

SEQ ID NO: 25575 - protein, 86 aa, Candida albicans
NSQFIFFCFFLVCLFVWTWFSSVWIWILVFGLIKFFWKIKNRKIENLFFQNIIRVNFNHFQLYNSTFTSNYFISLNLYPNEWDRII

SEQ ID NO: 25576 - protein, 75 aa, Candida albicans
SIFEKRRDEDLRTEMLNFAHFFFKSLSFFHRLNSPTYLIINTVAHSRSSYNICQWMDKCIDIDYSPRRGRSHSDA

SEQ ID NO: 25577 - protein, 61 aa, Candida albicans
LIPRAFQFNMYYMLLFVRSVLSSSLDYIVDISVGLFHRKHSDISEKNIKWGDNRVLLNLDR

SEQ ID NO: 25578 - protein, 78 aa, Candida albicans
LPEFDTQFVHSYLVIVVVVVVRGENSETQSFMLIFTSKKKKKMNTQRRIQFENVAITFLPPPSYGNSHNRPRLVIFIN

SEQ ID NO: 25579 - protein, 150 aa, Candida albicans
IHAKNKAGAATATAATTATSSPNLKIRLQMSQEDLLTRVTPVPLDEIEDTNPIIPKRKHWLVPTLYRIQKYSAYSFISFLGIHATSVILVPILPIDQLIKDEVFAMAKEVYQSVPLYEPICIIGSVAAHVMAGISIRITRNVFKRNHCII

SEQ ID NO: 25580 - protein, 61 aa, Candida albicans
VEIFSFFKFKFIQLIFFHFFFSLLTHWSIYFTIHYLFINQSINQSTNLFIYILYINSNRLT

SEQ ID NO: 25581 - protein, 60 aa, Candida albicans
HAYITSVVVVVTTFTGIPDCGICVFVAIYRMSAVNERRVLDVLFVRLYIDEPITLSLRVD

SEQ ID NO: 25582 - protein, 60 aa, Candida albicans
KHIWLWIRLVLNVNPADRLTTNCDLKSTHEQPKKKKTQKPRDKSGQHILNYPLIYNLIPN

SEQ ID NO: 25583 - protein, 68 aa, Candida albicans
KLIQILFSPRILTHFNHLRIISYVEETPDYLIPYNWSLPPDQNRFAKYKQLRNARNSSQATVGCCTIV

SEQ ID NO: 25584 - protein, 101 aa, Candida albicans
IRYNVGTNQCFLFGIIGLVSSISSNGTGVTLVSKSSCDICRRIFKLGDEVAVVAAVAVAAPALFFAWIHFTNMENVIGAELRHQEIGQVYQHKISLTPIFT

SEQ ID NO: 25585 - protein, 96 aa, Candida albicans
STDFSHIIQALAIQKRGTQFSKLEKKNMDEIRVELMTFPMLRERATNYATRPFYKLVNVLLLQNKRIEKKACYITTNWILRTFFIADLQGLSILSI

SEQ ID NO: 25586 - protein, 60 aa, Candida albicans
TRKCATFTEQKNREKSLLHYYKLDLKNIFYCRFAGTIDTLYLGQSALTNIRLRLHSIAPK

SEQ ID NO: 25587 - protein, 101 aa, Candida albicans
SKTHTNLTRHRHIGIKTYIIFPKEQNNGNNVSTQQKYEQGKNNQNLTHVANVSVPNIFFFCLFGAYSISVNSFISYHHKYLYRCYNRFCIGTENQRGLEQQ

SEQ ID NO: 25588 - protein, 73 aa, Candida albicans
QTCQFLTFFSFACLVLIQFQSTVSYLITISIYTGVITDFALAQKTKGGWNNNNNRKQNYIGSNVCLTLDLINL

SEQ ID NO: 25589 - protein, 64 aa, Candida albicans
PVDELKDRGTDVPEMGFALIMGILFADGVLLLALRKNAANDALEVDLLLVIDTLLSNEDDGTLG

SEQ ID NO: 25590 - protein, 60 aa, Candida albicans
KREQQMNHSLDSIGVYVEGEKEKMKISKVRKNEESSKDLNSFFYIFFLLVIIVYILLLYI

SEQ ID NO: 25591 - protein, 67 aa, Candida albicans
HRKKEIERERAEISWKKNIKIQTLKESDIKLERVCECVNMWDVYESHNLHMTEIKYSALPSPPHIYI

SEQ ID NO: 25592 - protein, 66 aa, Candida albicans
AHIYIEYASLVGVKLQVTKRVDERGKRQNKKFDNKKQRHIEQTTNTSHRKEECYPSLHHGAGRIRT

SEQ ID NO: 25593 - protein, 67 aa, Candida albicans
MCVVTPTLLPRYNNLWSIYTQFPIIDAEKFHMASRDKCTSLMNMSTESTCTESKLNKSFQLTLANWW

SEQ ID NO: 25594 - protein, 68 aa, Candida albicans
NYFIILRCTHTLVFFSFPFPFFLFPFFYFVLILFYINFLLPSTNHYPYLIFNRFSCHFFNSSFINNHR

SEQ ID NO: 25595 - protein, 64 aa, Candida albicans
LKITKTVVPVAVPAVAVELTIEQDNRTYFCKTDPTNELTGYYLVDVKVFLFFFKLKELKKVCYN

SEQ ID NO: 25596 - protein, 66 aa, Candida albicans
ILCQKNSLSLTKRFHIKIEIYTFTEKLNYIYTPKVSYKYKYYHIKRVTLFQHTTFNPLILLNQKDH

SEQ ID NO: 25597 - protein, 61 aa, Candida albicans
FISEPVTIDSTSWKSESPNENSEKSEVRDAAGLASLPPSIVSLTSSVLPLFFWDFRNFLVS

SEQ ID NO: 25598 - protein, 100 aa, Candida albicans
SPFFHPMPFSRTFATKSTIKNALSLEEFLFRSRAISIYRELCREIYKTHERQDLMRFLRDEFKVNSKQSDLQYRKYLLSQALNTINQMTASLGITIKKNL

SEQ ID NO: 25599 - protein, 84 aa, Candida albicans
TKKHHPQKYKQHIKLARSNKFYIKILKLYSNPRSLYFNISLLFFQFFFCTCKVELCILFFFFYFFRSQIVTFFKTPVLDNMIKL

SEQ ID NO: 25600 - protein, 325 aa, Candida albicans
LLNFPSFQQHKLKHDRYYTLDWTLILVTRALDTLIISNFKSIFHTNLKTAKTVGAYGDIVLFVSACFFIMDSWFFEPEKLTPHYAKWITKASHLDENVLLGIRYLRDGELDYHPTKPLPHQNHFKDFCIKYNKDPKLGDLNQIDKIPCEILHQFTTKSCWKHVLILFRVQFKFAFKLYATLNTFLFVFIKKFRGSPLKYLYKTIRSASFLGAFTGIHWAAFCFIRNYHPNWFGQKFWDILAPKAGSALCGTSILLEYPSRRNELSLFVLPKALGTFIDPTPTESNIATEVIAFSLSFAVLIAYARLQPSKLRGLVGKGLSYMVKH

SEQ ID NO: 25601 - protein, 72 aa, Candida albicans
LIRCLLQLLFFVSCASGPITQVLLKQSNEKGPKVVGTIRSNEKGDFLKENLKAAKLASDISVVTTGCESPAL

SEQ ID NO: 25602 - protein, 134 aa, Candida albicans
PQLYIVIHLSPPTLHNTYYIVMLRREATTIRLSPEDILEYDDSVAQQQKQKQELQQGQEQSIPQQNPSDFSPPNILQEQINNSSHSIIPDFKEESGSIYQRSRVSQQQQQQQSQSHHHQQQSRDERIGIQRNHG

SEQ ID NO: 25603 - protein, 79 aa, Candida albicans
THIDTHTTKKKKPQFDSCYQIMSTKVDQVITLAQVLSLLDNSESKKSIIWKEFGNYLDKSVDIEDPDPSTFIRIGNPLH

SEQ ID NO: 25604 - protein, 68 aa, Candida albicans
SSKLSNERTASLYLQGRKKKKKQNKTKQNKTETETETKKSERKKKIIDFDIYPYLILIVIHYINIIIV

SEQ ID NO: 25605 - protein, 89 aa, Candida albicans
LLKITQQKTKVRKDNFPVFLKNYLQNRPTIFNFHFLQQSRSLTISKRGVNYMQCGIVVVIIAHHHIHTAPGRTHRTHTPSHPEKKKTKQ

SEQ ID NO: 25606 - protein, 66 aa, Candida albicans
  UNSURE (19): Identity of amino acid sequences at the above locations are unknown.
GKYFEDHEPKSKFIKIRSXLALKKINNQLNLVIKAKNLSFIFFINLMKMIVNFMKSNHYMKFFQNC

SEQ ID NO: 25607 - protein, 63 aa, Candida albicans
MMLANINYYEVFNFLLNFPQILLYYGCEELYGIIIGFVNVHSPEGYKNIIGEVVVEHYYYNNF

SEQ ID NO: 25608 - protein, 64 aa, Candida albicans
RLLVLFYFFHSMQTSISTTTIEDHLHHYSPEESQKLLSRESSINTDLFKHENGMYIFWNVYKSS

SEQ ID NO: 25609 - protein, 120 aa, Candida albicans
LIFLLKIKVLSYSLILCEFEGSREDERTGEREQGISRKKGRAREKEKQTRIEEEGTNGEGRQARRGGDINLDENKQSLVPITSRISLPLPSPPPILIILLLLITLSSFFYPLNYYCLSIE

SEQ ID NO: 25610 - protein, 69 aa, Candida albicans
TNPPFLPFYFFFIFFFFSGIVILLSHLFKNLIKYDFKPDIYNPLNNPFHFVELEKEKKVISDNTILGNF

SEQ ID NO: 25611 - protein, 79 aa, Candida albicans
FLELILSITRVRDSEVIQLKYQAPFYQFNLILKSSDGSVLNTPTHPSTHTHPQQKSKEIREKSIDGGTKFSHLINNNNK

SEQ ID NO: 25612 - protein, 80 aa, Candida albicans
IDCCLQMEFTFLCLCTDLWLKNFVRVLLDNFFFCNQFSFLHSKAIMNCFTYTCKCILYNYLILTHKLIEKRKTKKNYQKE

SEQ ID NO: 25613 - protein, 115 aa, Candida albicans
TPFVDSNQFIKLSNDELRRFYRFNLINTWLNNILDSCFENFFFVFWTGNSLYFPYGCISKRNFKIVAAFHEKSINHTYYLIELPQTQVQIMYGLEYIVFCPSPSPLLTHSLPFNE

SEQ ID NO: 25614 - protein, 131 aa, Candida albicans
IVDNLVLIAKWEKLMLPITFLQIYMSPSNKLVSFFLRKIQYLQLKHRHIIHPLKIEWIAFYEKKEKKQNNWPVCVYMYVCVINNHHTYIVLLFTLPPNHTLIIPLIITATNFFIMECLQSSLKEKKNTSKV

SEQ ID NO: 25615 - protein, 69 aa, Candida albicans
ILPTTHRNKNHRIIKNSNSFFFLINNYKYNFLKHSFQKFPKYNFHSHSREFLNLHTTSFFTHGAGKSAL

SEQ ID NO: 25616 - protein, 70 aa, Candida albicans
DKNGIMSSFRENNAKRKKNIRTRKNLEYGWKYLNRLHKIGFKIIFLLLLKGGKTKTTINDESERIVFCII

SEQ ID NO: 25617 - protein, 70 aa, Candida albicans
NKKPYKRIEYIGLRGAKICIQNYNPSFCQTASFDECSKFQSIIAHNYQGTHRFDHCIYQSTIRWHLRFFV

SEQ ID NO: 25618 - protein, 62 aa, Candida albicans
ISCNLVLFSHGVVYQEEYQSYRKAKRIFFFIPFFFLQVFPSAAFFTMNQHSIQQLLYGDISV

SEQ ID NO: 25619 - protein, 63 aa, Candida albicans
ISEYRKKNTLVNHTARLKICLILQDLRQCLGKLYQYCGSFSNVYQVLPEIKWWPKLVQNLYIL

SEQ ID NO: 25620 - protein, 104 aa, Candida albicans
ENYGRIIFRKFQHSSHAPASESVPFSNKFGFDLSPPPIHEYWNIHNSTILFAFVPVFLGIAYFAKYVGKTVDANAAYLGYADSEASPVSKIPFGQSQAAPAKEE

SEQ ID NO: 25621 - protein, 218 aa, Candida albicans
LVHTHRNMISRIGLRTPAKVLSLSSRGVAGYTSRIALTRSYATQKATIYDQSTGQTIELADPEHPELADFKNPPFVLKQYLDPYAKYDDPQNRRNKNDPMHIDEDMLDLWSPDYYDHVSDSTALKHNAIFFGLIFGISAVIAYFQLNPEKPAMIRSFPYNGLADALGATSEETAPFYQNKPDLTAEKECGILPADNDITNNQAAYEKENSEFIKSGTA

SEQ ID NO: 25622 - protein, 186 aa, Candida albicans
ISSCRSSKHIKHILTRKPEMPENGRLRRTLARLTQNGTSTSSSTIYQNGKRTSQHAQETSTASNKKRKVSTQSKEDKLSDIIVDFNLAVNELYQLKEYKSIISWDPIENSSANDRGIKAEFEEFVKNNDYRLVWDKEIENNSNIDSLPLRFQKKKLAEQNKLLDDKFLIRQNLFHHGPEGRRLLGE

SEQ ID NO: 25623 - protein, 86 aa, Candida albicans
KYNYMKNKPKFKSGETNVCMFICRIVSLASCDGFQTEYKYRTKERKLKKKQKPVNGKPGFESILLFDFIRTGNSSSSSSSFDIIDI

SEQ ID NO: 25624 - protein, 88 aa, Candida albicans
CTVKRGEGVQFDNNKYIRSKKQYNKRLFDLISSKVRNKAINKDRVRNEMEGKKNQKTTHIIVIYTLLFSLFFPPGFLLLNSLSIFTFH

SEQ ID NO: 25625 - protein, 80 aa, Candida albicans
FGIFFAIKTHHKIHLRQVSVFTYQLRKDLNYRSKISTTKAKRFRLETTTRNWNSKRKSPTSICLYQIRQRSVFTADCRTR

SEQ ID NO: 25626 - protein, 65 aa, Candida albicans
NNGKWCNINRRLVMHSGKELKLGIGKNSLQEHGVTKSHYSEPTMTVIFLSHYRYFNCANYVSVLL

SEQ ID NO: 25627 - protein, 79 aa, Candida albicans
MRSLRSLVKKGVIKNKWSWMKRTRGKRITNKFEWDFGFYLYVGLINSYSSFNPLVLKFIFLYYYVHNFVVILNSGSDSK

SEQ ID NO: 25628 - protein, 83 aa, Candida albicans
ILKFCYFSTKRKMLIFITIVVPVQLCVVHKRKTHWVMGLIQGRILENGVVELQSYIKFSELDNYNVIVITGGGEMFFGLSKNC

SEQ ID NO: 25629 - protein, 173 aa, Candida albicans
IENLPQTNYTMKFTNIVTASLISASVTQAAVIPQSNEDLAVRADSSDPISGLLGGLLGGGSGAPAPAPAPAPAASGSAIPQQAEATGGAAPPAGQQSAAAPSDPISQVIGLVSNILEGGFSTSGALLHNLIGKRDDSSAAAPSDPISQVIGLVSNVLEGGFSTSGALLHNLIG

SEQ ID NO: 25630 - protein, 132 aa, Candida albicans
IMKTSVVLAAALTAMNTANAAVIPFFDGELSINYDAHSGWSFGFDKQPAQSGSPPATTTPGSGSGSTTTPATTADDGDDDEGSCDDSGSAPPANNGGSNGSSSGSGDYFSQWKQGLDNLIQKGKTWFSGLFG

SEQ ID NO: 25631 - protein, 81 aa, Candida albicans
IFLLLIQLCVVLFLFYFISILIIVQKNFFIPFSNIFTTLTGYKLSWGEYHMIGFLFVYKFFVIYRFQFLGISNFFSHNINK

SEQ ID NO: 25632 - protein, 77 aa, Candida albicans
LFFSFPLCVFFFCFVLSPNSLTRAEEDLGRKKDNTTHDIFVGSMCERHFLNENWLGRENFSMCFSFSFIQRFETSDR

SEQ ID NO: 25633 - protein, 113 aa, Candida albicans
YRNQIHGERLCKVREKKKCQPRNFPTNQISLITKLLEMICPGKVILVLIQLILFIVAGINCFELGKELIVNDSHGDIYRIVFPGLVFVTFLLKLFVLPIRSKLTTSSKEVKSL

SEQ ID NO: 25634 - protein, 76 aa, Candida albicans
AFHTNQELALAILQHLSLKCCTFPSGIFEKGLFPELEIFKYIGNYESTYRANKYHIALHLPSNLRHLFQKKDEIPP

SEQ ID NO: 25635 - protein, 200 aa, Candida albicans
RKYGFNTLMLKLQQREKFLIHLFGLHLSKSILPQEYLRSAHPVLDKNVIKIFLDTHPKCDIDQIMSFVNNELINYVGKNDTRENDMGQNLRESDLRESDLSENDIQQNELSESDSSENDLREIATKETVSELFENQCQNCFGLGHDSYECSLAFRNNQYIPDLFSRLQSFRGNRIQNNNRNVWSRFSEQDESIANTEKGN

SEQ ID NO: 25636 - protein, 73 aa, Candida albicans
FNCYFYYLNVDFIYLILIVIFNFTYYILRVTIIYDKTLIVDIECLFVSSQRIFIGGGRKCLFGIRKTIKVGSK

SEQ ID NO: 25637 - protein, 98 aa, Candida albicans
HKRNNIFVDLFFAPQENIFLNTHKWGSTTFVYITPRGEKLMLEEFFYNPHCGVKETKEGISGFFPEKISKNIGVFIFKKTFFGPGEGEFWKKPLGVFL

SEQ ID NO: 25638 - protein, 198 aa, Candida albicans
LLVYLKALQYSMSESDQLNSTNNTGNTFISLDQASTIMADQTQGGNPQQVMSLARLLNLDNIGAMKAFESVDFPESLKLESKINFQVWRNEILRYARGIGAEFENFVLNETPAHLYDLRLGNMLHQLLIRTVKEKVRMPRQELGKSGKELYLDLIKSFGTQYPYDKFEIVKYYWDQLTSPLINVNRRLEIEGSMGSIH

SEQ ID NO: 25639 - protein, 296 aa, Candida albicans
  UNSURE (10): Identity of amino acid sequences at the above locations are unknown.
RGFSSPCGRXKRVCWFPLMNSSIKSSQINLPQSKKLIKKQITPLQPTPPIISPIPIPQQPSTSIAVASEELRLPVPPPPSPPPVPQPPPPIHPSPFISNTIDDDNAQTSLSYSSNLLNYCQESVATPTYPVVATKNSDSGVRNATVIYRKKNTEELDYNLNEISPISYDTNSLRVVKRQSKLSANSKLEAHTLSNDFKLEKDKILSPDLEIVMAKAEDNDDTNIEIKQKNILETPTSFDNNQTPKIVGDNDSYTSPVSTELFSNITRRGVLVDYCDLIRHNCNFNWWICSCGVYFG

SEQ ID NO: 25640 - protein, 72 aa, Candida albicans
PCEKGVSGLSPLRLEEYHVSILLIISLSQQVTPSSKVSKDRAETKFINNSNVSNLLGVTVDLASKHKIANGT

SEQ ID NO: 25641 - protein, 62 aa, Candida albicans
SAHSSSESNVASVFSTSCEYFLSLGDNFVLDRRELIFSDKSSLSCNFQTKSELIIPIGDIVL

SEQ ID NO: 25642 - protein, 86 aa, Candida albicans
ACKYILLLVIPIICKSLVPISNKKLTGHSILATTVKRNQSVREMKKKNIIETRNKQKIQLSLHSCFPVLFIFFNSYLQYYITNWYN

SEQ ID NO: 25643 - protein, 698 aa, Candida albicans
  UNSURE (19),(110): Identity of amino acid sequences at the above locations are unknown.
PTLEVRASKSSDDSSETSXYCKTHPKSDQCEKLVSDNSVTIALSIVLPCLAIVAVLGYFLYRNYRKDKKESLAHDPDFDENGEATALPDYPQMIDYQEDPFHNRNSVRYXMDYSNNKPYSKQYERASKQQQRPLDPYLDSFVLPYQHQTGSKLSLDDYARKLGDLQGYQTPSNVGSRSRSGSMHLDGNLKHTMAEGRGHSRKPSSAKSPSKKKDGKQYTNIPNDSDPSIAEPNARDIGRGVQEETSDESENYSSPEEKFVVSYENESVPNVNNDVPQIFVSEENEESTENSNSPFDDQQDQATNTTESTMETIPHTKQAATNNYDDGDFTFSTEGDTRNTTATEQLTTSKPRSPRISAFNLLKNDSDNEEEENEDDNDDEMNELSPEQQEELKRMKSVYKVYFDKEVTGEAAPTRKYEIDENYPPVPDKINDELKMDTEYAKRFSNTSSVYQEHDEQQFVQQHQQYYYDQFNQQYQQEYGSPVDPQLYQQFQEQQYYNYYEQQQQQRIKESKRPLPALQKIPRPSDIRKSTLQTYTDFKPSMKNQTVTSSPTGKLPFVPIENDGVWTSPVNSPSIQSQASFPLQHQHSIQPDGYFPSAQHQQPSSSSSLTQQQQRNVSPSTNVPSASQMARSSVVMLNPVTEITKQRKFKPVGSIPRINNNPRPGYQQFGHRDLNGPESDLLPGNRKSDVRRMMNSNF

SEQ ID NO: 25644 - protein, 172 aa, Candida albicans
HMSSTPVTPQTNSSSKVTVSTSREVALEQELSQITNINAVLEQFLQTIEKVNGDLNQINNGATNTMILMNKWTDIMSQADFTLDVINNSGWIPNDEYDNEFGEGQQQQQDDNEDEEEIEAKLRALEQENLEISKKIENQAKEKNAKMNRAREIDSKRKRELGLFNVRKKASR

SEQ ID NO: 25645 - protein, 67 aa, Candida albicans
YKNMQKKKKWSNVLSINQYLSKNYSTRNDLWNWSSKKEKQQHQTKRAGICPLLLFNRFNIKQYYILH

SEQ ID NO: 25646 - protein, 76 aa, Candida albicans
MIQRLLQISCLILLLKPTQKNFMFTFDYPFIYIYIDTIKIKKEKNTLKNPCNYTKKKTSLLNKHNNRCLMTNEKKN

SEQ ID NO: 25647 - protein, 60 aa, Candida albicans
VLLIYLAIVRKQAPLVPLPQDISVMKNLEKIYLMRKSRIEGATLPYYVNPERVNLFDELN

SEQ ID NO: 25648 - protein, 67 aa, Candida albicans
PFMIQDKFLLMEKREINFILLGNNKIHRIPKNAMNWQSQQKYSHRKYGSKYNTQSMPGLHTRADFLV

SEQ ID NO: 25649 - protein, 62 aa, Candida albicans
YILTMPPDPNSMIAELARLMNCVQLDETVLQLCIKLLDEGANPQQLAKHILAIKKETNSILT

SEQ ID NO: 25650 - protein, 64 aa, Candida albicans
SGQSNLNQHFLVEKKNQLEKRKRKQTIRKYKQTLGVRHSLKHNQPLITFILNSTYLPCHLTQIP

SEQ ID NO: 25651 - protein, 98 aa, Candida albicans
PISFIKEPEILSLSNGSLLEHHYAIEKTNQQYKNINNRLKNTKKERIIELLLYKIRLLKRLTKSSSSGNKLDNLGAIHYYCLESYWSTIMLKRNKSTI

SEQ ID NO: 25652 - protein, 62 aa, Candida albicans
QIIKVLLRCYLIIYKGSYIIKLSNERKNKNDAKTQNKIKNMQKCKSNLKKTKQYKTNYKQIQ

SEQ ID NO: 25653 - protein, 69 aa, Candida albicans
  UNSURE (54): Identity of amino acid sequences at the above locations are unknown.
SSILFRHLDMHVVLYHVSIRNTIDPEKWKCKLPPHPIIIDYFGNQLPLDMILLXHFKSQVFKKFLTPQH

SEQ ID NO: 25654 - protein, 61 aa, Candida albicans
LDNFPTRPRVAEEELRNFLRIYNTFWALYNKSRTFYKTLFILKCGDTLKSPSIRQIMIVQS

SEQ ID NO: 25655 - protein, 83 aa, Candida albicans
  UNSURE (41): Identity of amino acid sequences at the above locations are unknown.
TFRRFSTHVLGIDLGTINSAVPVMGSDQEPQIIENEEGKRXNTINGGIQQRRRNLSWSSCKETSCSKPRKHLFCNKEINWEKV

SEQ ID NO: 25656 - protein, 61 aa, Candida albicans
RNKVEVTTLETRQLKSKLCTAIVSNAVIHLVKFGSLFEKVALSRGVFARLNFDTFFWQKVN

SEQ ID NO: 25657 - protein, 65 aa, Candida albicans
HNLPSSWRSITSKSNLLFASEQRKGLRQQCYFFFPETVLTLNINIVRLNFSQFLFLQQWKFTKTI

SEQ ID NO: 25658 - protein, 71 aa, Candida albicans
FELLKGCSDIEYYNNIYEEKTNRIFFLGNLYCTINVTLNELKDMLTTICEMIKAGYGTKIFALNKRNIIAV

SEQ ID NO: 25659 - protein, 88 aa, Candida albicans
SFAFILTRMRFATTQLATLACFILTAEATFPLRGLFNDAPVDVDLGVYHEESGNNKEQKVDGFNMSPNIKKRTHESSARTDDPDYFPK

SEQ ID NO: 25660 - protein, 60 aa, Candida albicans
KNILLLHNVPRMSEDTIYKTCDFENTFPHTHHIVIEDNEVKIVYYLSLRVVTFEIIGEAF

SEQ ID NO: 25661 - protein, 70 aa, Candida albicans
FNSIRILFKLKTNQCDEKFNRKKMVFIVSCNLYTENEKQNKKKIRNLNKTILKEKKHQLFFMYQSKYSIQ

SEQ ID NO: 25662 - protein, 63 aa, Candida albicans
MYMLTKVEKKKITIKQERARLLNYYDACQSYRYYRSRGKLQNHNHNQHQTTSMVNQLTKLITI

SEQ ID NO: 25663 - protein, 86 aa, Candida albicans
VKRKKLCKKKKDSQPFDTIGKPNMSGAILKNQLKVHILGAGAIGSLVAHDLKQKFPTLIKPVLLLKQESLVEPSLNHPINVTRLHD

SEQ ID NO: 25664 - protein, 67 aa, Candida albicans
SDFGLVPLNLSAILLIVKVNKADVTANGGNKSSKYQIRLGFISGTKHFIDSFNESKLPELSSTISDR

SEQ ID NO: 25665 - protein, 73 aa, Candida albicans
VLDVPPAAVDENGVIYPYKNSRLDPVWASAAMALSSVSVVLSSLALKLYKPLLKAEDFGVDDSTESELSPNEV

SEQ ID NO: 25666 - protein, 514 aa, Candida albicans
TQIISIRFFFGYFLSLIICKTTVTMTDGIDYIDVCKTDVLGLDTLHHTSVIPSPIPTITFDCLPYTILSNICTYLHQEELINFSLISKTSYLPAIGTLYLKIIVTDNIDLTCSVKKAIKKYPRFCGTIISISNFGKLLNCLYHNQHLAGLLRSLSLDLNQESVNLILLLGIVRGLKLQSLVAPDIPFSYFSMRGRLNLDTIKILAVSAKDVGLTPLQFTELESLKIFYNETSRDKRNIRQLCKVLNEGNSLSKLRHLEFSESLQIKAPTFLNITNDDLDLDSIPAWAHFFDYFSNGKITRKLDLDSLAIEGWVGKKAKECMIRILSAVDLSKLNHLQLHVNEKYPKNEQHTSQRRLLDLITERTPALQSLAIKPTSDDLFIQHYTIIKTLKQNLVHQLKHLLLVFESPMAEQSLEVCSTICDCQHNLESLLILDRSTAVVDSELLHCCLSFDDYLLSLYDYGLIYEKKIVDLLFSDVLLTDFLKLDERFIINDYMLELARNATDNLATRLEDPS

SEQ ID NO: 25667 - protein, 76 aa, Candida albicans
LESLAPVRDAFVEEVDVLELPLLLLAKDGTSKEDCIGGVAVVFVVAVFVGVLGDDVEEDTVFELFVSVDAITIGAT

SEQ ID NO: 25668 - protein, 63 aa, Candida albicans
VINSIILLNDKSVLREGYELSSCRTQRISHSFFLSSHQYKKISSSTVTLENIHNNDYRRQQQQ

SEQ ID NO: 25669 - protein, 218 aa, Candida albicans
HIMVDNTFEGLFKRINDLELILLDDNNNKVNNIGDHNDDKTISSQINQLKSQLSKLYQQYPEFQKLNNINSQLKIWNKLHLNTSTATTTTTTTPIDKETKLEFLNLLYDDLINTDNYEKMISIINFQYESIINGINNNYLLSSGSINDTSELLAKRKQLNQIMKIHQALIIKSMIVLERYIQCTIRQNKFWIDIDDQLVKINAKIKQLELSKLQANKY

SEQ ID NO: 25670 - protein, 133 aa, Candida albicans
TNFQTMTFFHSANYFGHGGVNASIPSSSITNVSQEFADIISNSQYTDYSSYKYLIGVNDPPIDFKVTNAAKYLPNEIETIAHLKLIRTFSVMKKRVIGSADSNNAANLWRIFVTRAVRRFIVFVTAIKKTVVI

SEQ ID NO: 25671 - protein, 67 aa, Candida albicans
YKYLTYLGSTQLNTNQIFLLFDINRLKLSQHVYVPQLIFFFFLVGFLLNTDNHNFARIKNQKLKIKA

SEQ ID NO: 25672 - protein, 112 aa, Candida albicans
SRHTMINKNLNLLLKLNKLDFVPPNSNFGGSSSPFTPVDQTLKTPLEAPQHQTEFPLQHQFQLQQQGYHGNVNQSSLYQNPEVNESDDNLTDIDETCNLTKAKFHIVFYKPI

SEQ ID NO: 25673 - protein, 102 aa, Candida albicans
VKPFLQEFSKLSSPKIFGPSESKHRALLLYEQTSYTYSKYESRPSSLTTLLTLIVVDYRTTESVLETCKESQKLKNFYWGHYLRVRTPPITEERITPLAFKS

SEQ ID NO: 25674 - protein, 66 aa, Candida albicans
VMKEMLRWKVLIMKHFLIQEIYCENQKLLDCALFSTRVLIKFIVKMSNHSHGIGYLTDIWNRLFDL

SEQ ID NO: 25675 - protein, 77 aa, Candida albicans
LLARKIMLWQTWRELFVVEDGEIFALVDEDSAPVVRRQLDDLLLRQIEQSHHGIPMTTCSQTTSMCWIHLWCKVNCF

SEQ ID NO: 25676 - protein, 239 aa, Candida albicans
TNKNNFITPLFPPTMPENLQTRLHNSLDEILKSSGYILEVIDQNRKQSNVITSPNNELIQKSITQLLNGEIQNFHAILDQTVSKLNDAEWCLGVMVEKKKKLDELKVKEEAARKKREEEAKKAEEIKKAEEAKKAEAAKKAEAAKKAETAPQKFDDFDDFIGFDINGNTNGEDMLSNMDYEDLKLDDKVHATTDNNLDMNNILENDELILDGLNMTLLDNGDHVNEEFDVDSFLNQFGN

SEQ ID NO: 25677 - protein, 78 aa, Candida albicans
YKKKRKERYLGYRDRVSVDTFSGRKLYLLCFLLITNNPYRVLGLILTNIPCIQTIKTFKNSSLCTTDVSNTLTLFVNK

SEQ ID NO: 25678 - protein, 60 aa, Candida albicans
PRGGTGLIYGSLTANKNDLYVLSTPNSKIPQDLANTNNCLTKLNHSKTTPCCNHHNKSTI

SEQ ID NO: 25679 - protein, 90 aa, Candida albicans
LLQRAFKAYKQWIFNYMLVKVGQQILFRKNIPEKKTSTQSSLTNLYYWITIKAKAPQTVTDLLLLQIITNNLLWIIFIRGTLAIDEKRGP

SEQ ID NO: 25680 - protein, 156 aa, Candida albicans
  UNSURE (8): Identity of amino acid sequences at the above locations are unknown.
WGRNPGLXKSIGNSIFKKLRKLILGFNSAKTEPMKYGKFSLFTMLKQLRRLNDVTEFNISESAAVTTKTRYYSETFQVSVNDIDDDNNLHIVSTLGHGWTQCQLTNIPLLQMNNKTDERAQFRYAIRDEEFGELVNTLLDTIDFCYITGNKIYPLK

SEQ ID NO: 25681 - protein, 66 aa, Candida albicans
RGTTVSWLLSQATLEITKTVANSAYNHKLEFMKLHSNVFPLRSSELAKTYQKSHFNLTKHTKSQTL

SEQ ID NO: 25682 - protein, 82 aa, Candida albicans
LKKLQKKIMKGTRFELARSTDQQITLVKKDLNLHLKSVTLDQLGQPSKFDVNSKVHKNQKGKTELRNEIEKCKETKASKFKR

SEQ ID NO: 25683 - protein, 63 aa, Candida albicans
HNCKLYYNHSLGGIRKSKKRKVEQQYKSERKIIGRKIDAARKMFCPKEPFSSEVFSFWCSSPP

SEQ ID NO: 25684 - protein, 74 aa, Candida albicans
RSLTITNLYLRNNIKLKLKTNTYILYNLISDFCIIFSNPLRSDPVVHEPPHTTITTISSGCKYLKFLYNKSILL

SEQ ID NO: 25685 - protein, 65 aa, Candida albicans
NSWGCVDALKPNSSIDQHIINFNIEIYRNFFNKQFFNSDDGNGSSEYLDTLKINLDDNNSHCSIF

SEQ ID NO: 25686 - protein, 64 aa, Candida albicans
RGDVKVQIESDYDQEEAIDITSVVPLLTDRDFKTTESNNRIVRFIRPDVFLNFRYVKRILPDTL

SEQ ID NO: 25687 - protein, 175 aa, Candida albicans
IMKFPKLRKRTVYWAVLTVFALFTIHFVFQYKEHNSHRVQPIVLIPKAFPSLILNSLDTQNEELVPIKLLKNCQIIRSYHTGYEENTKLLGQEPQSNFHKFNFTVFSSMKPIGLDLKQCQLLSSSSQVEVNDAVNMDASLHDILGKLLQDIRHGKLEYLQEIAPSSRAAAGRYNA

SEQ ID NO: 25688 - protein, 155 aa, Candida albicans
AIINMSYNPESFKEHTNFQSVHSFLNLFQSKDFNDSIIQLEAPSIDASREVSTSPTNSKGSTRLNFDPKQYYHHLEQLPQAQPQLQPQFTEQFQILNLNKDLCERNTATRTNKKKLRTSGNILTADQISRTSSTSPALMSPVFTNDLLSPSPELN

SEQ ID NO: 25689 - protein, 69 aa, Candida albicans
  UNSURE (16): Identity of amino acid sequences at the above locations are unknown.
KPYFDGDYMKNVNRVXRWIQDDIFQLHDNATKNSNPAAHGLFPRMDLSAHNNFMDIKETPLDPVAHKRQ

SEQ ID NO: 25690 - protein, 76 aa, Candida albicans
LYKLISNWRGNEVYGIAKDGVWLLIINLLSSPSVGLRNEKLVNGLDNDTKVSDKQNLLLTLCPLIHLRLIHCYQYS

SEQ ID NO: 25691 - protein, 83 aa, Candida albicans
KCEIYLYWKPPEKKKTYAQNYMYCTQSRAIALILYRKNFNYGAKSVSNFFFFRCSLFYGNTVVSRECLALTEHFFQNRKIFEI

SEQ ID NO: 25692 - protein, 61 aa, Candida albicans
NKNKNSRIQVNYKSCLIKSIYLIFDINNKSIFYIYRRTEQDKEIFFNLFYFTSSKPFIIQI

SEQ ID NO: 25693 - protein, 63 aa, Candida albicans
TTKHTIPRDTLRNTIGSLDSKMIATPSLPKRIDNQNDINSGEMTLLQSFLKAGNELKLYKTLS

SEQ ID NO: 25694 - protein, 75 aa, Candida albicans
YRPSYCKKTIPCYTQIKKLGTYLMMMTKFKPSVTISRWLLKNENDGKQMEDRSMFELLRQRFWLKHQQTMNAEYK

SEQ ID NO: 25695 - protein, 60 aa, Candida albicans
VSVLGKSGRAFTLFPYYQYFDKFMQMDNLDTCHETQLKLWNFNRTYTYSPPFSIHIGILI

SEQ ID NO: 25696 - protein, 316 aa, Candida albicans
ELEVITFGGNIPLILASVVSSGIPKRQDHAEGQARQDAVEILLSLGKEFTDSIGRKFNNSYYEESFILNIAYVALYILNQKERSKDQVYTPFAISLFQNGFFKVAEATCISLWNKLLIMDPELASATLDLKYISTQESSIIKNALGQILMIFAKTVNHENIPNVPFAKFYFYQGFESNIEQSLTSALLLQIRSVALSLVEHTVGSKSQLTGTNKHPDNVPTPLIEQIAVIIKDIFVGKKELSDSEFIPFDTRNISPPLDQFAYLISLGMSEDQAAHFFEHGCNLSDIASGKFLRCVEIDLKEEQWQSIAALSEIFH

SEQ ID NO: 25697 - protein, 112 aa, Candida albicans
HSTDPTNFHQSEIVILDFDIIGWKLTNDISPVVKVPVLSKSIILTPVIFSKTLAPLINTPLIAPTPVPTITAVGAANPKAQGQATTITEIDNFKQTKNFPLVSFWKIFGNLS

SEQ ID NO: 25698 - protein, 137 aa, Candida albicans
FIIFSCYHLPMGCFLPLNIVLPPVAAGAAMMFSSLSVVFSSLLLKRWTPPKIETKKTFIDDLEMGNNATGGDGDGFSLKNGTIEEFNNVKRKSAVNFSSLFAKMTTTRRNRRGGGGGGGRLNGNNNQSYELVSNRFS

SEQ ID NO: 25699 - protein, 73 aa, Candida albicans
SLHYSCKKIRAPPPPTQKKNFPILFNTLSTALQNKSSTMNQPSKEGSKKFSRLLSYHWNFLGNYTDEISILIL

SEQ ID NO: 25700 - protein, 97 aa, Candida albicans
FCFRNLRASVDHNGHKNRYKDLRSFDCIYKIRMTNEMKSRSFLEINNTLLKKGINILDYFDLKIVLKPVQSGILAKLGDFHHKWHNLLKTRGLSDIG

SEQ ID NO: 25701 - protein, 60 aa, Candida albicans
CYVYRGIILIVAKKSNLLWNTYSIRSTRKSKTPNKTKQTRKAEGKKKEDTVVSSTTHDLL

SEQ ID NO: 25702 - protein, 83 aa, Candida albicans
FIDLLLWNTLILLMVVIAVVISKSIQKKQTWNTRLELLSLFISHIHTLVVHYFATTFLIILKISIICEEKKKERKKKYIAIHP

SEQ ID NO: 25703 - protein, 395 aa, Candida albicans
FQIIFRSESSYFCYNPSLHFTSLYFTLYNMWRSLLGLDNDDSELINQPTIDYNTISSPSKQPQQPKQNSQKNKPLDKPRNQTFGTVIDYSDVEDGDDDDEYLDLNNDIKTNTRLINQWRTNNIQPTTFNPTINQNGSINRQPTLTNVSLPDQYPGKFPHLKNDNDVKQDNSVNLLEADKEYESLIDAKIQALQREIDNNDNDNHNFPRNVETTHVLDEIDNLQLKITSQIKTLQELNELVDVYEDEIQSNNNTIIIITTTTPIPTTGKLIIDYKDYQNLKNEYMNELNRVKKLYEAYYLLFNRYISLKRSYKQQKEQKVALSKKNDEDKVDKVDEVDEVDEVDEDDKDPKDGRNGDTISIKEKINQIKSKTNDSSIKTICDTLLKDVTKLEKNWY

SEQ ID NO: 25704 - protein, 103 aa, Candida albicans
YNIYIDIFKGFPKLNEIDQWQVIFKTKKNNRKEQNGLVKTYHHIVKIYNNCIVLFFFFSSCSCFQFCTFFLIFILSMIPARLKMSFILHIKMNKDQTKLTAMP

SEQ ID NO: 25705 - protein, 65 aa, Candida albicans
LPCHSNYLFILMPLYSRTKLESSQQKPINTNMVNHRRQKFLIDGYTKATLLWPMDIVNHHSQYQF

SEQ ID NO: 25706 - protein, 130 aa, Candida albicans
GTRIFCLDKICRVECISFNRNYIVVKNPQLECIILYIQTNYLPFNPLGKNYSITTSGNNFTYTLYTLLNAINSLSTSYDDSSSFPFDTFSNNTLLAYKVCILQIVLENLPICDNYHIVEVLLCFAYSCSA

SEQ ID NO: 25707 - protein, 101 aa, Candida albicans
QKKNFSGIRNNLVDIYWTSDFFLPENVITKIPVIFMAVVRKKYKSSPVLIIIIDILNIENSYHVILEYDLNHEYQRNQNKKKELSTALCQKHKSLLVRTFL

SEQ ID NO: 25708 - protein, 60 aa, Candida albicans
VISIEIFFFSTMMKWMYVLVITQRYVASTSIRNGPVYNEIKKLEENFIFCLPCAVVGLVR

SEQ ID NO: 25709 - protein, 74 aa, Candida albicans
TNKMLYALATPGSAFKPSIKKAKNTWRLQKFKKLYIQKGGYISSSPTDSSINSNDSISSSSSVITASSSAPRFI

SEQ ID NO: 25710 - protein, 62 aa, Candida albicans
RSAIEGLLSVSKFEANYLLQFLTNIASKVFSLFQQCMILLDTPVGSIVVNFSCKICGSFLTI

SEQ ID NO: 25711 - protein, 63 aa, Candida albicans
SHHTFTPAKTFYFKEQLDSHKFTKTIEFLMPLLVMKGYITLVLNKTIGGGDGEIFLCELFDCS

SEQ ID NO: 25712 - protein, 66 aa, Candida albicans
YCVIESTAKQEKKTYRHKKGVADEIQSIKTHSTCLTEFSLKLKNEGQTLNIVERKKKQYQMKLSLY

SEQ ID NO: 25713 - protein, 103 aa, Candida albicans
CTYTSFTCMHFTILRNGNLTKGNLKDVHEKVYSQYSKFFSHLSISQKVHTNPTELTNCQAKSKFSKFILVLVFFVFSTLSIRSNDYLATMKQYRQPISVKKKV

SEQ ID NO: 25714 - protein, 82 aa, Candida albicans
HCLQLRLMATEKNLLLTKRDFCLTKNARVNIIHYSRLYVETSRLGRIHSFIPSSKDKKNAPIIPLSNNVGFVMKLVTIFWKD

SEQ ID NO: 25715 - protein, 295 aa, Candida albicans
QTMGLTDKLKGIKKDDVDNINSQAGKYAGGKDGQTGTDLAQDKYKQYKAGKTADSAKDSLTGQNQGAGSGTSGYGAGAGAGTGSGAGAAGVGATGADLTNAAYGGTSQSGTGYGSSNTASGHQQGSTHSGSHVDRSSAGGYGSTGYDQQQTSGSYGSGVTGSHGTTGAHDSTGYGSSQTGTHGNAAYGSSQTGTHGATGTHDSTGYGSQTGTHGTTGYGSSQTGTHGASSTHDSTGYGSSQTGSHGTTGYGSSQTGTHGTHGTHDSTGYGSTQSGSHGSTVARPQLLHRWIEDTV

SEQ ID NO: 25716 - protein, 74 aa, Candida albicans
HIRFRYSVVAVFIVVVALSCLAWVFAPKENTTVFRSSVILALSMCYLMWAITYLAQLHPLEAPRRSDLRPEPKD

SEQ ID NO: 25717 - protein, 88 aa, Candida albicans
RPVGKPFRIFLVMWVFVYKFEESSADVKKKSKSQNKKGALTQKKKSNLRVINNISCRLKPNSKDTRLSKMSGYVSFSVQETYIIYGVI

SEQ ID NO: 25718 - protein, 146 aa, Candida albicans
FLLICQLNPLFVIVVNYRYKLFVLDIQLSSENTKINRKQLGITPFIYIYIESREQYMGEISQLRVLEFSKRPVYSYVISRYLPISYFPRFFFQLLYRFQYCCYLNRRLKYKMCGSKEYSKQATLTDEMKQRAITNNILEPRGSEKR

SEQ ID NO: 25719 - protein, 86 aa, Candida albicans
  UNSURE (14): Identity of amino acid sequences at the above locations are unknown.
NDVPEIYSMGLWIXKLYKSCYNFLTRLYPLCLLYKLIKRSIISRFATVDSTYAQAHPKTNSRYYFKIQNSGNRGMRPRFLIVNNNN

SEQ ID NO: 25720 - protein, 84 aa, Candida albicans
ASLGVILYGRHYENLRSHTDICIMLAMHAYFTLLAALSLCDPIVRIHKNLDIYMDSPYKGKKAAHDDNSTYLVLKDIEKVIESL

SEQ ID NO: 25721 - protein, 330 aa, Candida albicans
NVYVLGINFEYFTGLNLVFFTYSTLVLTNVLNGLDLNMVGDKNDEIFVIIFFSRKFFKSLLVYVTSMEKDITELKNCPSIERVHEILVANVETPSFPYITALLEFTIPQLFDSIRDSKILIQTFQTLIGLGNLLNRISTRQEQSELYISILERVFDEGLALNLVKGNPSPVEIREINKLVFKGKALAVVNEATTLSSVEITSECFKSTGGYVEYLSNSLLKLYLSNTRSDIIEEFLHSTLKFGDASVIKFYEIFFRESSWDYFVQSFQSMKKFQKKDYLKGLFNNYIVRIAPNSNLNALFNLLSFTSDVFDEMVIESIIQTANKSRLHAR

SEQ ID NO: 25722 - protein, 91 aa, Candida albicans
LVPSVFFFAFQLSFTFFHYYHCLPPYFAEFSKFIQNMLVIKPYYYNYSFLYFFPLKHVNLLIVPLFVILFFCIYQLEYISIHEFIIYSTNC

SEQ ID NO: 25723 - protein, 65 aa, Candida albicans
GTVLWNSGINQLQSNALPTKLPRAIADVENFPDFHIFKIKVIFPTKHKFNTLIKCSNFSKSPKDF

SEQ ID NO: 25724 - protein, 424 aa, Candida albicans
TTTSLLGNPIMSITVTFPKSPSTKKRAPAFGIELEFSQQGSSDGAIEKAALAVPVFSVDNQDFVLIRDLAKYWGYPSSYQLIVKLVKCANIEKSQILKTDKDLNKELFELDLIEEADTKIDLFYISLPLVYSRIENKKVFYVLREPEQPKVSKAPTQEKPASVVAAEEDDDNLDDDEEDEVDEDMDEDNDNSGELSKGYKHMHKDHPKYINDDRVTIGQVFHQYGLDPSTPLTHSLFNSINSMSKLNYYKNFGVSGYRFLPNSKLSYAERELVLNANNYNDMHINEKTESKPKKSFRKPIGKSKKHNLQIDPNSIDLSESVIPGQGFIPDFSIHHLCKVPNYYVTSNHQSLPLSFNTKNLNATSNSSYLFNDNVKIKSKSIQKLVFNSDTDNYHHTKYFYTKTYRGPGSGKSSPRGARIRHKGA

SEQ ID NO: 25725 - protein, 63 aa, Candida albicans
TIIFSAEFSSSCTELNAWPYLDVSPTLIKLVSPSSSTVDDKYEAGRKGTDGSGREWNSVLIGI

SEQ ID NO: 25726 - protein, 79 aa, Candida albicans
TRSMEGSSNRSSFRACHPKYLEAFDANPGAATLLKEGKNDSAYDSSNSPKILGISGCNRAHNARIANSTTGSGTFRFGR

SEQ ID NO: 25727 - protein, 148 aa, Candida albicans
HTMEVATSNPQPKPQTINKQVTFQFANECDLEIHCSPFGLSGLYIKINGTDIMGIGSTMGLITGSTRGLIHYNDSNDLIDQKYKLYVVIDDDDMLRIDFTKIYTDASNDNNEKQIQEVPTLVFRGKCPEGRPDTIEPFIGIFSFERET

SEQ ID NO: 25728 - protein, 62 aa, Candida albicans
TTDISTIKLTHKINKIDSITFYHEPHYHSLIGEEMSEEEKTSVSCRQTLYPLKPRLKCWRRF

SEQ ID NO: 25729 - protein, 61 aa, Candida albicans
LLKEKVKNEKKLYNFIWGKIGNILYSCYFACEKVKKCEGIKIMWGEIRDYGNGTFLFFFRP

SEQ ID NO: 25730 - protein, 115 aa, Candida albicans
GSQDASPPKTPTVLSNDDSQETTEDKEETVSSLPPTLELTNGETVEVVSQRIYNDILNKVHNEATSAFFEQEESTKPKVSYTKDMKDDLQNYYHKAEIRTNRAINKIIQDKLIQE

SEQ ID NO: 25731 - protein, 72 aa, Candida albicans
ECFKGHTFGVTSRFEDSIVGKGDQLLSNGYYFYVIDKAYVKWWGREKNVSYPHLISIISRCNSSSSSRKKEK

SEQ ID NO: 25732 - protein, 64 aa, Candida albicans
IKKGCSIIINYYMYILLPLFFFLSRTTTTITPGNNGYKVGIGYVFFPSPPFHISLIYDIKIITI

SEQ ID NO: 25733 - protein, 130 aa, Candida albicans
LPFVMTKLILNPGDLSLIFPDISISNPQRIRILCQVIKYIPNESCLIIDKIPTVAESSTNKESLVKIDVFDILEDILSIEIINKGTIINIDGYYDGEKIQPIDIYEINGINFTIENIEILNQLNQMKSLT

SEQ ID NO: 25734 - protein, 112 aa, Candida albicans
LDENDDEFILFRFPVSNSSDWSAEESELALDPEPDPEPEPEPEVGLLLLTLFNFSFLYLVMASVASFNFVIGRINQTANGNVTKHMNAPIPMTTPIVIFRSLLAGPLKTELD

SEQ ID NO: 25735 - protein, 65 aa, Candida albicans
TLILENPMATFLPKNDLTPVAVPEFDANAVFIDEDELILYMVPASNKLFSTGKTNLNPITSLSPL

SEQ ID NO: 25736 - protein, 80 aa, Candida albicans
SSSLVEFNAERMDSAAATMVRYPEIDGCSKIIELFDSTGTVIPIKYLELKLSELLAMGPVKYNPSGVPNTGGIDLFGCKG

SEQ ID NO: 25737 - protein, 64 aa, Candida albicans
SMRWYFFHNKKITYLSNINNRSVLGMSNFSYDLANQIGRRIIKINKEIELKQQKLAFTNRGVLL

SEQ ID NO: 25738 - protein, 62 aa, Candida albicans
SSAFPASPVGEDELEKIRAQNQRLQQNIMKGLSVDACIDSSDLIDVKAEVDISIYNRGDYTE

SEQ ID NO: 25739 - protein, 88 aa, Candida albicans
QLLYIYLFKVITIESKAHTRYQTSINKQLNRQTRLISEGVNSMSTTFDSHTKTAFFVVASPIIRLPQSPSARIINICLGFKTVLVWSL

SEQ ID NO: 25740 - protein, 91 aa, Candida albicans
QNPSPIYLLNKYFNFVMKSNKELVTTIHKAKFLELGYGLVKTTLVLWIMLLYQLFSIHDNSLFWPYGFILSNSGAALIDVLDLVPVLAFGR

SEQ ID NO: 25741 - protein, 74 aa, Candida albicans
VLSFNNQSKVTTIWPNPEHHLPKASTGTKSKTSINAAPLLDRIKPYGQNNELSWIENSWYKSIIHSTKVVLTNP

SEQ ID NO: 25742 - protein, 64 aa, Candida albicans
LPNDNDSLLYLSFILLIGIDKSDIPPKQKLETASRYHNILKLMALMGSLIHFQKDLNSNKQLLD

SEQ ID NO: 25743 - protein, 66 aa, Candida albicans
  UNSURE (20): Identity of amino acid sequences at the above locations are unknown.
CLHPRVLIYSVLFSLVEGKXFASSRKGRARGIVDRQRLLVNHMCYKDQTRAVLKLQSCRVLDVNWA

SEQ ID NO: 25744 - protein, 74 aa, Candida albicans
CMLLFVCEKSIILERIRVFPPSGKKRKIGLCEYIRTRYYWKHMCERESEREKIRETEKETENHLIQNQNIEIKI

SEQ ID NO: 25745 - protein, 503 aa, Candida albicans
LNMKPDILTVSLCHKYIARLKHEENNLEILNLQTSTVCRSYNLQTLVRQFSQSNYTGPCVVSQLQWEHILPDSVSTKLAIVVDNLHIAMIIDFRKEDTEPIFIKQPKNEGIESIEWIPPPSEKDLGAYTNSRQLLIFSKHDLAVRVFSLDCTHVLFTIYKPISSLLIRPSHDNRFWSILANTLEYNKPPVLYHFYNEGSVSLLIKLIKLPNTLTTEPKLSWSDKGTWLQIFNDHETIFGYNLLVYDLLGRVSERRRIDPLVDVDILDNGYNMGSDDHLHFSSNEFQSSWVTLLSDREYIVVSDLQGHQLQIQIIEIRLLRVIKAIELDLKDKQGWKQLWDKFVYGKIALPENLEITKVYSHEFELYICINNTYVVGCDLELTDSDDIEIEIESIVEVDTVIVDFYKNDNKLVLVSEKQIVTLNDDNDKPQKIFETNGTIKNTQPNADQITIIYNTTQKTLWETVFTSNKFASPRKKRHLVGNTSILLDDITDTFNLKKRIKSK

SEQ ID NO: 25746 - protein, 126 aa, Candida albicans
  UNSURE (126): Identity of amino acid sequences at the above locations are unknown.
IMDNSNTHSSRGRPGIIINPPTESNLNVHHIPEEEQASYDEDYDPNKTYISDSQYWQRQSSSHHEDDLASIEIPELHQIQDRAPDSLLAHSDKRSSQSGRDILNVLHLSRQARPGPLIQVHQHQFX

SEQ ID NO: 25747 - protein, 62 aa, Candida albicans
FYSAASFTSSIYSKLKTSEFTDTSNRKQDSSVFVLGTHIEETIRATIIVHKNEMGNIRRPFR

SEQ ID NO: 25748 - protein, 130 aa, Candida albicans
  UNSURE (1),(16),(30): Identity of amino acid sequences at the above locations are unknown.
XERDFPKPRLEITAWXNPNLAVDDVLKLLXTIKGLTVIVSRLDDDNFMIVSRLTASQRAEKINIDFHPDNPELNYLMEANLCYDSDQIYCGSEISLDDVEDENGDDYEDEVEVESDDNGEYTYYDEGELI

SEQ ID NO: 25749 - protein, 99 aa, Candida albicans
KNPQFIIIEMFEKMHLNNLIIVSNQDETLMTGFIDRFILNDLIIDKFEKLVDKLNDYQVIQQFDIEETAGRVEMTEFNYDNDEDDDMTRIDRKSIELIT

SEQ ID NO: 25750 - protein, 61 aa, Candida albicans
ILFGVNQSLTNFDVITPPIIGNTYVTAPVISNIITTTDIVNLVTPVMKDAAPSCPRNENRV

SEQ ID NO: 25751 - protein, 64 aa, Candida albicans
KKKNFCEKKIEYMRVSAKLFGGNTQSLPQHPYISVTLENVCRRLRRAHHHTKSPYYVEIFFFRL

SEQ ID NO: 25752 - protein, 63 aa, Candida albicans
KQVFSKRALFSSASEIVSLTGMVFNERQKCGSVSYQVLIIDLAQTLPKKELKESKPRIMAAPV

SEQ ID NO: 25753 - protein, 61 aa, Candida albicans
DCSVYFQALICHTDILIIDPSLEITDLLKIDEEAREDKDEKKNQYIKTKLSLFLVIPQIKQ

SEQ ID NO: 25754 - protein, 147 aa, Candida albicans
MSDPLADYTNLSHDEIDPSSANAAESEQAEPEQQVSEHYEPQPEELTYENDENVLNSIKVQKITDAEAIGEVVRKKVIRDSRPQGYEQGDFNDNSNVTSGSRPGHQQTDEIDISSMDPQQRKRFELEERMSAAIKPSNKRRRKADGR

SEQ ID NO: 25755 - protein, 77 aa, Candida albicans
KSKKKKKFKGVWNVIMKEKTKSRPFVVFFVVVIIIISIVLNRFQYKQVLDWTERVLRNRYQCLDCCNAGLCVYARNE

SEQ ID NO: 25756 - protein, 916 aa, Candida albicans
RGRLSHGEEVARPKKIEQFYTPPQNFQDIIDQNENNIPVEGSFVEITRPDFRPKIGLVVRQALSRFDARYNKLLVLTSDNELIDVSASEVNFHLHQMIPHDFINCQQIVTSRHNKKYKERIRAIEFLDSFINDVVDLKTCMEPMFDRIYAQVSTNSISHVTLVDIIDAIKYQETLVIKIGLSFYNQCVLLFSIHWCLVSSPKWIVPNYFVNNKLTNVLQGHSNNFHTRASYFVTPGNISVSISKFMRYMKNSDSHEIIEKFLAQLKTRNGDELSHFLQVYDGRHLAYILEVIKFAIVYPHDSIIKQLNKLASFKNCSTPNDLYNKLLDLNIYDKSTDVVLSLGIVGSSDRINVSSADQLQIENLWSGEHGDLFRHLRAKKKYYRDHIIYGLPLDDNETCSRFAISLETINSRKYMLNIHIPDITTVLPPGDFMMENMFDKFTELSNKFSNSFQSNLFSNRFEESKRFHKYETVDSENLWDDELSQNSKSQRNPSKVTCMTISFQFNSYEPEPFKSFEDKISISFDSISNLNVKVLDKELLKKCLSGKLETSLFKLLRRNQTQGFSDRPHLNKGDIHNINYINGIMKTFFKMREHSGAAVIKPQQESLVSSSSNFLSKIGVDKPRLYSHSDFILRELQIFTGALVAEYCTQHRIPAMFHCQDVEPTVYDLDKVMVTHDNIMIPPYDSENYHHSILAKDSDGYISLQASFVSKNYLSPENVIAGPGNNNLLLGLKNGYINIVDVFTKKEAIINQYQLLSYQQALFSRNLSMEKGYLKTVQQFNILKSLGYQLQGPLTESRLGSYIEACYQSHEISLFVGSISRKYVVLKWLEKAQIDINEGNGLEVFHCIVTLVGKKYDLGVVCKCFCMELGIEVDVLTENSDIHIGSKLVCDKVLQVNAIDRTCLLRDENYGSTWYL

SEQ ID NO: 25757 - protein, 359 aa, Candida albicans
YKCQNKIPLPDYTNRTSDNYNPDTTDNHNIPPPFTTHPIEVHPPPFSSSTSPNIRVPAYFQNQTTSGWTIVINNRFWTDGFRIFVSEDASNKFDAFKKSKNPEIIQLQEQGIGVPLFKAVTSYIPLATKFITFRRYVPTNLHPFDIDKDYYDYCIVKRKLHVGYDSYIFEFTPDPKQPKLNFQVILFSHSILPIHDYIYKGERHRWIDESNLRGFKARWQVKYGFKHTYLIHGQPALTDNWDGKSDKLNKDKKNPYLDNFLKMKFSVLSRFPKQEYYGPHCTDTLGEAEAFFKLGYAELKIDDLGRGIPEGDDDNGDDVNYESIFSIPEDELVTICIATVLKRQKDIEEEKKNRRKRSN

SEQ ID NO: 25758 - protein, 66 aa, Candida albicans
NDKKILKKKRKIEGKDQINDKRLFHIYMYMYMCFCIYFFNYGFYDLNNITSNRYEKDKEIVKFTTI

SEQ ID NO: 25759 - protein, 72 aa, Candida albicans
IFYFSSYVLFLEQKNCACANSFSFFLVTILYHVMYYFWFFSDSNLGSVAVPAVMNLHNLVLENLLLFVLLQV

SEQ ID NO: 25760 - protein, 71 aa, Candida albicans
FRSIALSEIPYLERLNLRKNQKKGGFFLQPVFDSKLSIGDILSCFNIMPSKLFNMYQWYLEHTKKNNNNIM

SEQ ID NO: 25761 - protein, 61 aa, Candida albicans
QMSRHLKTTEIRHYHNHSETQTKNKAHALLSWNHPVFYNVIRFFCWVKLLDLSIIADLKMN

SEQ ID NO: 25762 - protein, 73 aa, Candida albicans
RRWLKIFYSKHLMYTNLYILSHFLEFSQPYIQIVIIISIGVISFYCPFRDPIPRKAESEKEPKKRWFLLATCI

SEQ ID NO: 25763 - protein, 67 aa, Candida albicans
YLVPFYFFILYTITITITIIIKSYNIHIYIPFYDKNKIDQKFSSLLSLQKREYLSLFVTFSINADQV

SEQ ID NO: 25764 - protein, 67 aa, Candida albicans
MQTKYKLGFKYNNNNNNNDRRDKALVILIDEKRVNPYSCKNMKREQMKKKKRKIQICGGGGVWCVHA

SEQ ID NO: 25765 - protein, 68 aa, Candida albicans
EKTICHYQNLFWSKVSSKIGKKRKMNSNDIVDLSIKFISNRLFQILLTSIIQTPVNLLSNIHNNINIL

SEQ ID NO: 25766 - protein, 67 aa, Candida albicans
TKSSSITLVKYLNCFGCNLYRSLLSLSTNLRKTKKEALNSVKKIPIYSLPALCIYNKIQRLGLFLWL

SEQ ID NO: 25767 - protein, 99 aa, Candida albicans
KMKRISSSRTVQKKGLLGCHYYFLVSLPCSFLCYLHKIYARPHEVDHNCYEPLAVDVSSRPIHTFRCRSSSHVIILLLGPLVIVFYLTFFTPPSRTTRW

SEQ ID NO: 25768 - protein, 71 aa, Candida albicans
LEREVKKIFFLTTIVIFENSHSHSALFFKTPSPSIAQHPQSLCLKKLIKLPNKFKKPIWTMSPVNKFPKPN

SEQ ID NO: 25769 - protein, 99 aa, Candida albicans
TNTLRGKRAKKKKFFLTRNCIPQQLQTYQSNSPSTMLRIGYRGFSTRSRVFKLSPQEYVNQVQQEKIENEQFKQALSQDQLEYNPKILSSTTGGPKHPR

SEQ ID NO: 25770 - protein, 75 aa, Candida albicans
GKGNKKFILLPKVEIILVIPKYFKGKVNSEKGGLAVYNKKGGNKGYFFFLGVGYSFLVGEIFSPPLNLGCGISWK

SEQ ID NO: 25771 - protein, 70 aa, Candida albicans
AVHLQPKLEFLTVKPPNIGASMGPPKSTPANVEIAVPLCSVRNKSEKIAGETTNAADPTNPEKNRHIIIV

SEQ ID NO: 25772 - protein, 113 aa, Candida albicans
VYLHMVLGSSMVLRLIWILRQAWLIARENTWLILIMAKIVVAFIVIVDGSKFDISADSKFIFGFEIFGNNLTSLDISSLTNILHITIQICLLVGCKCINKNIIINTTLGYTSI

SEQ ID NO: 25773 - protein, 258 aa, Candida albicans
FVFNIPQFQQMVTASELNQLNVWNDKIEESTSCPESYIPDSISWMFGLSKICNTNNLSPTTNLRNKRLHYLFKNHGSTSKDQALNEKKNSSSNGLVKEGADSSIDYPTTQLNTHELTSKLELELVESSFLEYGINKVTTRESSHQGKERDCLFDSKTCDINCLNSISIGNSLPSEAEGSLFLQSTRDIELENFTAAPHQEFNTQMGHSPENMLIHSNPRKHRRDNNNMVYNCPKPVKRFKSKSQCDLVFPNLNFRNSG

SEQ ID NO: 25774 - protein, 262 aa, Candida albicans
MSARPGQSRRWKTQRNDNNNNNNNNNNNNNNNNNNNNNNSIITDVFQASRSRSISLPISKFKSPTTIIATVTNSSTTTTNTTDTNSPCSISYTSLDYDYDYDNLFEFNSPTSSYDPNFKNEKLTTNTIDDLGKEEKFLLPPLPSSATTLTPKISSPGKLDNNNNNNNNNNNNQLDKNEMDKQQIDLLLPSTPSNNNSKKYQNITSSQQLLSYENNHNHSNLIDFDNNNTKNDEELVAVDRLACSILSLVGKNTNNQNIEWNI

SEQ ID NO: 25775 - protein, 125 aa, Candida albicans
IIIERCFLLYIKQFIYLFIYLFIYLFIYLFIYLFIYLFIYLFIYLFIYLFIYLLANIIACNDVNYHPINYKLLLGCSQFFFTNYIKKPNLIQKKNRINGPRPKAKAKAKAKAKAKAKYSIQCFDY

SEQ ID NO: 25776 - protein, 71 aa, Candida albicans
CRLLLLLLLVFSLDTTHKNSSQQFYLLVASATHTSIYSSQIKFGITQFKVKNKQITNECIHYKLYPKLSLC

SEQ ID NO: 25777 - protein, 67 aa, Candida albicans
RRKRKKDRKIWLSEYCCCQNFDNFVILIFYTRDKKKVKRKRPNEREKKFIIIESRLTCSYIYIYYIV

SEQ ID NO: 25778 - protein, 81 aa, Candida albicans
KAEGGLRKRRRRQVHALIKNILFLKFLTSLNYTMNNDIIKVSKPFTLLTPNNMLITTEVVVIVAIVSDRDNVTLFLVVKLH

SEQ ID NO: 25779 - protein, 81 aa, Candida albicans
HLSLIVSSFGIVAQHLRFVESKQNQPMGKLLDLGQTFVNNLVQTIKWKSKGSLQLIFKARQYQVVYTYVVKERKEKEERNK

SEQ ID NO: 25780 - protein, 183 aa, Candida albicans
QTLLDRSNYFNATENFWCIRYYLLCLYGTDFTIAEQNMKQNIDLYYHFSIFRLLELQVIKEYSKSDQKYFIACIEGEKEMISPIFKRWLVIFNKFFDSDLLIKLILLGYPDIEFDDVFFEQPKLTTSLIRFITENLPARMDLIASIPIVCFNKAFKKELLNGLFFLFVSNPTKSSPRGGRTAI

SEQ ID NO: 25781 - protein, 345 aa, Candida albicans
FLVTPFFYYLLIIMTVRKARTASFFIDIEKNGFLDDDDVAYKQHLEKQLQLHQQRGGNGNGKGRRGESVTLTILVLCILSLTYFIYGYGSTILMNNNLQLDKSILLSSGLGSPEISILTQELINNYDEMNNGGIGLMISDELKEELKQQQQYYSQPKVANALLSGGDGITKQENQGYPATNNNDIDNEDEDYTRKTLMNNNEANNNVNNNYKDDNNNSNNNVDDNDTQNANYNAVETIQANLKEMFAISPMVVISQTNQIDELQTILTKLNINPQPKFINLSKHPNYLNIKQYLKKIYNIDEDDHIPRVFLAGIPIGDSDKIIEMYKENQLISHLREKGQGLINV

SEQ ID NO: 25782 - protein, 67 aa, Candida albicans
KEFLSLKTLAVSAKNILPTDSPINKKKVINIPKHMYFKFSYNAFSTRNQTTPSLPPKKKPMEKAQLI

SEQ ID NO: 25783 - protein, 62 aa, Candida albicans
KQKCNIKVVVETKKIIIRNSFLLEEKKEEVVKNGEKLLFNRLVTSTSTVLYFFTPTNKNRST

SEQ ID NO: 25784 - protein, 60 aa, Candida albicans
KIIVKPEAPRRKRRSEKNPTFFSLYLSIYICIISTQRAYLMPFQEFSLFIPCDFDNYNSS

SEQ ID NO: 25785 - protein, 66 aa, Candida albicans
YNKFKKSEKKKKQLRKSTRKKERKKKTNYKGLYLFVRLDYTNQRGNRKSRIENQKKKNSLLIMTLQ

SEQ ID NO: 25786 - protein, 131 aa, Candida albicans
LPWTIFKSKGILVFSTLVRPQMTHYCLHRQNKYLANTEESESIDVPVFKIDGSTIYPRVMRSGNNQPMLTRKHADINIFTIAGGQLYEKLTSIMIASVRKHNPYPDNKILDFGRFCDPTIQTLGRAYLSKV

SEQ ID NO: 25787 - protein, 237 aa, Candida albicans
ITFMTSTSSYTNVDFFSDLGKLPPEVITLIIDNIPKCMLPQLLYFPPIRKAVASSILSNVNITIPEEVGRHEWSDEPGVGYSRCKCDVFDIEFSDFKEGITQWHVYPKIFSMEYINNFKTIWDTFPQMITNALSIKGFFLWEDDSDTENDIHTGDDMHTKDLLKFFADSNIKFDSLNLAEFPGPITLPPITTNLLLLRTTLTSYEIPGLKKLEIDLYCAGEQNQSYTFTSDLEEFNN

SEQ ID NO: 25788 - protein, 71 aa, Candida albicans
WNSFFFELQLKFEVLQFDRGIWKSVWNKQWGYLGFSYKCLMNKIYLLQVKPATRIDGDIDIFLLISRGDFV

SEQ ID NO: 25789 - protein, 382 aa, Candida albicans
TGNSSVRHTPSNLKYNNLSLKELEHVDDLLDSYLDDSSSLGSIEGDDEGVDTSNILGDLDKDTNYDHLPLQLQEKVSDLTKDATQVETKHKPQPLDLKQAVTSFPPLPPPRGNFSSSLEVTNNSNNNTSSPVTPINENITTIIGERSPVNNYNGINDNIGDFPKPSRQSFEKQNKLASLASMTYQPTIISLSSPVKTKSESWGGKPNNTSIHNSIGGISDNHKHLNMFEPPLIFRESKPQPPLEGNKSATVGNTENSFGSTSRRNSNTSQHFGYGLSRITSSSSSLNLNAYLTDDDDDNDINSALMPELNRSSSISTRYSLKGIQQQLQPPPPQQQQQDKLQNIEHNEEHDESEEGDSTIIANNYQIMRNYNDMSSYLDGLD

SEQ ID NO: 25790 - protein, 62 aa, Candida albicans
TQLPCDATIRTSTTTNNKDKCKNQTNNERFFPRYSLFYCVIVSTLLTNSMTIYQTIIGFVPT

SEQ ID NO: 25791 - protein, 60 aa, Candida albicans
KLVKKNDKTETEFSNEMEMEMEMEMEMEMEMEMEMEIFSFMFMFYALGVIFLCYRKRISS

SEQ ID NO: 25792 - protein, 70 aa, Candida albicans
NFLQVHLDNQPALIHQFYKEHIPRNSVYINVLIILHTSPLPRYIRTTIFLDHIDSFTLYILLICSCCYLV

SEQ ID NO: 25793 - protein, 86 aa, Candida albicans
FRIRRLHQNHNSTNTYIESGLEKSNIYHSYTFLANIVRVLHILFTQYHNKNKLNNGIFYFAFQNNTKTVPIIPLLFSSGEGSWFYS

SEQ ID NO: 25794 - protein, 76 aa, Candida albicans
VKYIVLHQSQDAYVTHTNLNRGNNQHKNNTSMIQHPECNDGNAPKMIDELENPVVYISTPNNLSILPSPPGDPCIE

SEQ ID NO: 25795 - protein, 61 aa, Candida albicans
GILAHVKYNANQVKTGKAGRKNCDVKGIKKQVANAKIIGNFIKNEAGKTTNTKKSMETKNP

SEQ ID NO: 25796 - protein, 101 aa, Candida albicans
KTNFYYVKPFFYYYITCKLYFTHFYWLIHNYTENKLDCTVSNSPPIDFLNMVRDIFLLVLSISQLKQIVPDNIPSCLKHPQKKLSCAFFLVYNQSAETNIQ

SEQ ID NO: 25797 - protein, 80 aa, Candida albicans
SFNYIIASLYANPIPNSAHNIFSPIVANIFPNSKQTSVLNIIENENQVNKFACETSMKRRVETLCLSGSFDFYNFFFQQC

SEQ ID NO: 25798 - protein, 76 aa, Candida albicans
NKNSFLDYSRFCCYNCLNNFICSIHVFNLIIKLKLIQSTDSLAYWSNNIPELNFCWFRLFDTALHYYSPSSLLTNY

SEQ ID NO: 25799 - protein, 138 aa, Candida albicans
PKMNVNVDFLSQLIADASPLLHTSAEANGQFISPNPNLLTTHNNDSGVEFNSMSEFPNIDTLDFIPAAAGTGTGTGVAQQQQQQQQRQFQQYLRTPKSASSPKFQLTATNFSNQTTPAFGSVATFSNNLSYLMVATVI

SEQ ID NO: 25800 - protein, 71 aa, Candida albicans
ISISNYEVVVFSYNHQKVEALMIANISNQGRNQTWTAANTSIAEPIHIEMKSETENFKVRELTINDYCMGW

SEQ ID NO: 25801 - protein, 69 aa, Candida albicans
GIYPNYCRCPRYCCSPKYFLLPLSPPLLNNHQHLPEVSTNESVVITPATLTGYTTLLSRTNYYCVDHLF

SEQ ID NO: 25802 - protein, 316 aa, Candida albicans
SFAMRSPSLAVAATTVLGLFSSSALAYYGNTTTVALTTTEFVTTCPYPTTFTVSTCTNDVCQPTVVTVTEETTITIPGTVVCPVVLTPSGSASASASAGASSEEEGSVVTTQVTVTDFTTYCPYPTTLTITKCENNECHPTTIPVETATTVTVTGEVICPTTTSTSPKESSSEAASSEVITTQVTVTDYTTYCPLPTTIVVSTCDEEKCHPTTIEVSTPTTVVVPGTVVCPTTSVATPSQSEVATKPTTINSVVTTGVTTTDYTTYCPSPTTIVVSTCDEEKCHPTTIEVSTPTTVVVPGTVVHPSTSCYHYHHHC

SEQ ID NO: 25803 - protein, 121 aa, Candida albicans
LGTPLYCPEPTIIVLTTCSDDQCKPHTVSATGGETVSIPATIVVPSSHTTQVEITVSSASVPASEKPTTPVTVAAVSSSPAVSTETPSLVTPAISIAGAAAVNVVPTTAFGLFAIILASIF

SEQ ID NO: 25804 - protein, 103 aa, Candida albicans
PLIQTMATGYSTGVSPFDLDENNHNDSIHHRHQNHHSQSHDSLGERDDTEIEDIIQKTSKLNINTSTSTKIKNFFIHNPSQFSTRFTYKFPQPLGGNVSSSTT

SEQ ID NO: 25805 - protein, 65 aa, Candida albicans
FFFLQNCFNAKNLKKGENTLKSYTPVKLDRFNLIIPVCFPLFSIDILYVIESFYLNIFQNSTPNH

SEQ ID NO: 25806 - protein, 135 aa, Candida albicans
LLFNDLFLRTFDLNRDSIIAMIVSAIIKLAYQYDQLLTSYLQSNSFTSNLLATPISKLITEFLIIVFIVLFSYETIYWSGIYLKLWDYHAKDIFTEVPIHCSHVYIRLNFVDSENIELLDQYYFFTHAAGRTRDC

SEQ ID NO: 25807 - protein, 65 aa, Candida albicans
PHSKSTSVSVIQDSFLRKKLPSFCIDAIIPPFNILRYYKNRVKKIFLLIDHNIYHYIFTLSTVLK

SEQ ID NO: 25808 - protein, 75 aa, Candida albicans
FGRNANAGGKVQKRSQAKIQVKLLEDWVENQAETLKALKIDEGYDEEVVRRAKYFEENEHLIKEKIELLLGSNKF

SEQ ID NO: 25809 - protein, 189 aa, Candida albicans
RHQSKKMSSIWSGPAGLSGPLASTFKLYVQDVHQMLTESLAASGVEFNEDGEEVAPAITETDESEYWYEVASNSIELLEFIHFLDSRLSLKEKAESPIPMASIIFRPVSQLRDYLSAILPLTEKQEELLQTKRSTMKRPIDYSDRHAAAKYGDVFEGDEYLEANDNDDDYYMEVEGSPVDEDEDEEYLE

SEQ ID NO: 25810 - protein, 72 aa, Candida albicans
QRKYTMGAAYQIFGKTFQPHQLALATLGSVVLLVLPKPWGPPSPTTPPIKASSPEEEKFIQEWLAKHTEETH

SEQ ID NO: 25811 - protein, 78 aa, Candida albicans
LKNGFDNLNNKIRYQKSLSFSEFDIIWSNQSKFKIENDKHKKGTIYNRQYHHHHHHNHRLQNTFWLMISVTFVLLVVN

SEQ ID NO: 25812 - protein, 93 aa, Candida albicans
GTYTKKRIETTHLLQTTFPCYSLYFLLVSKRFEMTNILLKLRKKTSDEHLSNSDLLFQQLKQKYGVSVSTIKNNVNGAKLQAICHENWTMFYQ

SEQ ID NO: 25813 - protein, 78 aa, Candida albicans
CLDLQYIRKMPSNQVDIFQRTVECTSIPVSRSIFTNGKQLPCLYVGVSDGATISDFTNSLKSLAELRYHPLIYKEAMT

SEQ ID NO: 25814 - protein, 67 aa, Candida albicans
LQEYICHFKSFADQKKIERITRKGCLQQVCGFNSFFCVCTLGTESYSEVIYILLANTNTKVRQNLFK

SEQ ID NO: 25815 - protein, 258 aa, Candida albicans
LLCICLFNVYSMFTYLGDLNLRRGQNVWVYYPFFFYSQHLVLANKFSIHTMGPTRYLILQQIPISSLLDPNPVIETTENSESNKEINLLPRDVRYEILHHFNLRDDEITPRDGYSRKNNDYVEINSCTGFHYDPLLDTYISGTSGYSKRMNMGLSHATLNKYGIGGKYSRGRFYDFSKHNNPKSKPEEKTAQEPIRVKMVDLLPSLTDTEEKLFDESNLLHLSTKKRKREDDTLLDIRENTAIKLPPISTLPMPFPEH

SEQ ID NO: 25816 - protein, 63 aa, Candida albicans
KAQSHHNSYFVHHWSWLKNWLLLYIQILFTSDINKLKMAHFNLEIYIATKAVTNRDTLKLVAL

SEQ ID NO: 25817 - protein, 67 aa, Candida albicans
SWLLSRTSMLFNPIKSALNNYAGSKYSFSRIPQTKNSDNTQFCNTHKLTIIEKLSIYLMVLLIGMLS

SEQ ID NO: 25818 - protein, 90 aa, Candida albicans
TWKKNFFFVSLLFTKINKEKKYTSIYIYLLYMFNNFRRNISHIYRQSFLSNYRTMSSSANRPIVISGPSGTGKSTLLNTCLHLREQDTSA

SEQ ID NO: 25819 - protein, 153 aa, Candida albicans
LPEFAKYFKITTMQHPRMFNQTSTNAKKPNGSDSSIKVANHSNQRQMSANHASLTIGGSRNPINQRRSMLTKNIGSTLIVSRRNNHYLDMKEEDSKENLTKIISNNQNEEDTEVSVKVSVWFHELRDFTEDIIIDENAIPTGVQSSPRDEDPR

SEQ ID NO: 25820 - protein, 60 aa, Candida albicans
HTFYVHTYTSYIHAYIDIYTRFQKLNIFFMSTKSWFTPPYNRNQLSISPASFFQFLFFFN

SEQ ID NO: 25821 - protein, 62 aa, Candida albicans
FGARTWLEERELTLETFQKIAVMKEFRKLRVLFPKGKKIQHAYCFDLVIRITHEHTNLTAVV

SEQ ID NO: 25822 - protein, 346 aa, Candida albicans
GFADVPIPQDDFEDDIVNGYEKDIDDDVSALKRRVSNRKSRAEEATSLEDSTKEDEDTTIYNADVESESEQDEDDNNNEFENEDENLKRLLLRPITEITYLERTPNSKKLLVNSLSSIIQHKIHARIKELNISKNNLAITDDMASNPALVPLTTQLANRFNFLIDNLTRSKTSKKTINWKDILCTAVRGEIGPHSNINAKSYEELYNKCEKLFSTMRYNYEFESELECEDDIRTEDGGFNVHEYLKTLSNSVQASGQISYKDLVSRYPNDFSQREKEEARFKHNFFKLLGIQDQSLDISCSKTKREPEKKRRKVLVVEPKVEDLNEVKEEILGSVELDENSYMLNL

SEQ ID NO: 25823 - protein, 70 aa, Candida albicans
SYFFFGLMLVWLKYVFFLFNKCYLVQVINLVYKSPICCCSSVSQNESNWREEPNKGLNIKVLLSLKYYLS

SEQ ID NO: 25824 - protein, 291 aa, Candida albicans
QRNYFFWRFCFCFCFCLETNFYRLFTFFWSYLYYDRSHHQYSQMARPTIFPLKKDNNGAQLISRLNQLISITESLTTLTSVQRQELVKLFRMTIDMIILRTNQVFTEFINKCTRLVNSYQNLIMAVTSNEQQLSQALHPFPFPRSLQPPQLHPQPLLSLPALSNLRTPGRSNISTPNLQIRKYGIFHDRVSNLSPSISTQSMFEVAPNRKSKDISRMLLPDQEQKSSDESEFEEDESQDLIYNSSSHSLSPGRPRLPSMFLSNRLSTPNLQVHLNLSQKNSRLHLRNNSFN

SEQ ID NO: 25825 - protein, 62 aa, Candida albicans
RIINNNKFPFYFFVAFLYDELIYVFKTIYIILLILNFSSKCKVEITRKGSCCLVGDFLFNGI

SEQ ID NO: 25826 - protein, 489 aa, Candida albicans
QSRLSHLVQNQDPISLEQNPQLHTVYPQPRHSKQLLSLLKKNQQQDRIPDNMPLQPQENNRTLQNFPLNQFNANEILQNVQQVVRETVKLEILDSPNIDNTYKTDMMDSFVSLVILDYKDYLSSQFLFSLKQNLYDRREATHTNVDLEQNGSNENLFDEQPQHKHNHQHNENQFLYQLQIQNQRQNQNQAQNQNQSQSQTPGQNLNQNDSQTQIPLQGQTPQDRKSAMQQNWIPGSTPGVGGLIRLSPLLNDNDNNEYAAVAAAAVVGSTPGNPNGNSLENFTHLPGINSSTLNYLMQLPHPSANPNSGGVSSSQPTSSMSLQGHQGLLQQQQQQQPMFSMQNLGQQLPPLSSIPKLPSSNNANVNLNSSSTLPLPLNNTGPTLNPSSLLKSTSRNSTNSGNINVNNINNSNNNSNSAFNSVFLNSSITTNPAFIFNSQGNPTNSNQSMVNSIMTTNLNKDGTATSNNNSSGNTSNNLLNDMPNYGPGW

SEQ ID NO: 25827 - protein, 67 aa, Candida albicans
SRKGENLNNVKAETKGIPGCWKIEGLIKRKEQHLERRVNYPTKVDSKEKQNDANDKELEQLIDKLKI

SEQ ID NO: 25828 - protein, 92 aa, Candida albicans
LNDYTIMSSNRNSFDRPLNYRMSIGESRELIISPTHEGYSKFSSKTSVTHLPSLPYSQATTSPLSLQDNSQKIHGVYDDAYFQGGPKFTRPK

SEQ ID NO: 25829 - protein, 61 aa, Candida albicans
LFVGNWSARFPPKNAKKQQKKKKSNLKFANTSNRSKLILSILFYEFPLGSQPVSRHPTIAD

SEQ ID NO: 25830 - protein, 61 aa, Candida albicans
TKAKIKIKMFVLLYDALLSLSLSPGHTRIVLVNSRDYKKQSVKNFFFNSFYFLFFSSLTNL

SEQ ID NO: 25831 - protein, 293 aa, Candida albicans
YINIKMTTRFNLPGTFPIDDEIPSAPANTTYSTVSSTATELIESQQNLQFNNNQLIHNKTKYQFDILTQIDALVYIIIFYQFVKFCHSACLIPLVLHLVLQILLNSKIVTQNSQVPNLLSFLSNEDNQDTRERIYETFIHKYCYLLYIKTILVILYHTLFVATWVMYLVDTQQLQKLNHGTWWFISFIGEETPVIDKSTPYWLKLFELGLFQLIFTDVLILFLQLALYQCIYKQSDAFHLDRRLNEKEVYIIRTNADSTSGIDDQSVVTDADGVPTVLKIRLFECFKSDAYAY

SEQ ID NO: 25832 - protein, 74 aa, Candida albicans
NYDLTRCCKILETKPNQANKQKQKKYSSKLLSVYREYDFIYTHIFIFIYYLFYLVLVLVLTSRSKTTFTTFSII

SEQ ID NO: 25833 - protein, 86 aa, Candida albicans
IKSSCHFYIDVLDCRCVWNLPLVFLLGVGSIFLWLFPTFINKIGQKYRAKKKLTDNTTLYTLNRYTFILFLYFHYVYLNFNTFLPL

SEQ ID NO: 25834 - protein, 176 aa, Candida albicans
FTRFPTNLFLTLILFLFLFFFWPYLSFVDVYLIFADPLNMLLPESINSQNLVKRIVYYSSYDDYSGWWKWRWLLWLLLLIPIFLTIFLIARRGRQNKVVAYNNPPDPQANEAYYNNNQYQGGYNNDLPPQATPGYGTTNYPETSQPGYNLQQQLGDYNSGEISRPEGPPQAHTKSY

SEQ ID NO: 25835 - protein, 210 aa, Candida albicans
QSKINNLGILYYYIFIDEIHQSSLHIFFFFFLFLLLDICLCLNMLLPESIDTQSLIKRIVYYNNYDRSGWWRWRWLLWLLILIPIFAMIFLLSRRRRQNKVVAYNNPGPQPNGAYYNNNNQYQGGYQGGYQGNNDLPPQATPGYIPPAYPETSQQQGSYGGGYSSQQQNGYNPQQQNGYNPQQQQQQLGTYNSEEFSRPEGPPPAHTKGY

SEQ ID NO: 25836 - protein, 85 aa, Candida albicans
EIKVENIVSNALPILPTESISFYKAYTSSNCVKNEQLKTNLNLLIMMFNIPNGLFTIASAHLHSLKQTRILHLPFKRKQLYIQYK

SEQ ID NO: 25837 - protein, 69 aa, Candida albicans
VNYQEGGRGVVVLLNGKKIRWMIIFNLNYEENLVKANKKLKLEWTQLNNSVINSFQFIRIYLQVQYYYF

SEQ ID NO: 25838 - protein, 81 aa, Candida albicans
KNRFANHFVFFFSFFALSRGKKGAGEKNDFHTHSLMIIIIQIRFVWQLIVNTLEILKKKKRANNVITIFFFFWLFLFSFTL

SEQ ID NO: 25839 - protein, 123 aa, Candida albicans
PPFHLFNICFFVSFFFPRLLFITLIAFIGDEKLSHQLIFQTLKIYFTNNLLTQKRNHNSLKENYSNHSLHLLHFLFHPSTPNISTQPAANKKQKDYAYGTLLSLTLKRDHSTTSNSPSVIFAA

SEQ ID NO: 25840 - protein, 80 aa, Candida albicans
GRLIIIVNSKEQLNEVWQVLNLWGVEKSIIIIIIIIFVNIGNSRKSKKEEKKEGNRKKERRIRIKRKRKSEKKLKRNKQI

SEQ ID NO: 25841 - protein, 105 aa, Candida albicans
LIALPILLMYQLNYSISNLVFTFIKAWLWLCKKKKKTFGRTLDPLTRRKKKVIRFDGNFCFLLLANGKTVPLMMTEISVFIDVIHLILICFIIINDFIVCNLIGK

SEQ ID NO: 25842 - protein, 60 aa, Candida albicans
KKKEIVFTKGGRGVWEDCEGEEEKNFFLPKPNLISKSRFFFFHLIFNYYFYIYTLSIKPN

SEQ ID NO: 25843 - protein, 93 aa, Candida albicans
LYTIELFPNLRVILWRPISKFLIISQSQENSLYVWKAIMVLYHKQVLGPSSQSIGLNITIIKLNVAQLVMITFAPYYCKLCVSMLLQRGQDCV

SEQ ID NO: 25844 - protein, 217 aa, Candida albicans
TRDMTGRGNLGNSSRGRGGSRGRGASKGGSRGGRGGAKNGSSSGGRPNGDTSNGNGKGKGKGKGKVSKGKKSKEKGPNANLIPLGTPRTRKPNDDEGQNGPNQNQLNDLEGRIYDANEEAYVPPRLRQNPPNTAYSSANNFGTLPMTNNNNLNQYTVGNNQNNTVNNNSESTNNFQAGMAPAAAAAAAASPNAMGAPVTAAPVAEPEPKARLMHQLL

SEQ ID NO: 25845 - protein, 63 aa, Candida albicans
LINNKKKREGKNKKEKERTLINQTTINTFEGTNQIIESLAPPSPPHTDRCRNKNMYTHTHTEH

SEQ ID NO: 25846 - protein, 67 aa, Candida albicans
TLINFEYYNNHNRVSNCFLKNCTRFSANLHKIKHSFKSSYKYQLVSTPHINILKDQLYSKILQYLTV

SEQ ID NO: 25847 - protein, 333 aa, Candida albicans
FICWTFFFLVFCSHSFKHSYIYIYIWISSSTMEKLIQSTISLFISLSLKISTKSYKSIISILFIISLLSIILTTTITVYHDPERIITTTTTTTSASKRVFTASSPKQQDKLQQEIDQHQSDNSHVQQGKRIIIFPNNFPLIKNDQLVKYYIDIMNQALHPHDLIYRNCFEYKIPQLSYSSQKIDVFSDGGGGDQSGIKCRKLSSQVNVKVSPAINKNGNMRQILTRFMQDDGLYFQEFLPFFPNLKEQLQSADDDIINKHWYQFIGSTVWLQQYGVHLMISRIIYTEVDQGLPIISLAYLQLFDRNWNELNDVELIIPDYETTTTTTTQSKYK

SEQ ID NO: 25848 - protein, 66 aa, Candida albicans
RTEEEKEEKFFKDKIFFFLPCQVFKLIVVIVGMASAVNDKLTKFNYLIGKNDSFFITPSKDHVCRG

SEQ ID NO: 25849 - protein, 311 aa, Candida albicans
FIKFPITITNISMTIITTDIDLFQEVAKLPYEVIALIVSYLPKCILPQLLYFQPIQREVASTILSDVNVTESIYRHKGSDTPHVGYSECDCDWFQIGLSDLTKGITQWNVYPRALHMNGEFVFKDVLDTFPELLKETLSINGTISLCEGIKAQSLLDLFYNTNLRFDSLQLNGVWDPATLPSVATSIRLFHTTLNSYVIPGVKKLDMEMYSNNDEPQTYTFSPDLKDLRVYFNFTIQVTLPLNLRKLCITTSLDSAEFISDEMVKLEYLQLELPQMESFEETGIVAPNLKTLILTDCEKLSDFRNLEQFQN

SEQ ID NO: 25850 - protein, 77 aa, Candida albicans
PSLKDRSKSSNRINVGGSIKVLKSIFIKSRHLIDNSFKFGGKVNNGVSKFSRSIKPFPSYSKRSNIGKLSSLNKPNG

SEQ ID NO: 25851 - protein, 60 aa, Candida albicans
HFDKFSHRTQLSKHLSWKGSKSLILKIIYCSYFLVVAPRELFTASTNKQDGEKKKKIYEK

SEQ ID NO: 25852 - protein, 67 aa, Candida albicans
FGLDVFAKGLLCQLRESSYDDVNLVENHDLSPPPPFSVKLFLFFRIIRFFLPFSLNVHRYVYFQYTL

SEQ ID NO: 25853 - protein, 87 aa, Candida albicans
EMSKETPKLISNALKITSKLIESDTNISTIDLNLLENLNTNQSLNYIKLEKNMNEIEANAKHLQILSMYYCLVIYSCTVCTNVADRI

SEQ ID NO: 25854 - protein, 61 aa, Candida albicans
TTNVYPRLYSKIKNNKIQLKLCKKPIHMYIIYKQAYNIGQKLSLSFFFTQFKITNVLVSVL

SEQ ID NO: 25855 - protein, 63 aa, Candida albicans
VWKICHYFSQIRSERIIITTLKRNDKIQIHPLNNFNLMMHDLEKNGVRLREKTLITKPHSQSE

SEQ ID NO: 25856 - protein, 145 aa, Candida albicans
IVFLLLFFFFWFLQLSRIKSLSIMLRPVVQSSPLIVYRSYSIVQAAKNALNKVNLKLGKVAAKDIEYVESAATEMNKAAHKTADSAAYLNKKTGEILAEGIDMAQVAKHRADAISKVRKNKLGYKNLQDKGSKVESEQCRPDDGL

SEQ ID NO: 25857 - protein, 84 aa, Candida albicans
NHFQDIIIYIKGGVTYGESRLIYELSESNKRINLIIGGDGILNSEMWLQKLYSMVTKFSDEPGHSHRASEDSHINRQIQLRDIL

SEQ ID NO: 25858 - protein, 190 aa, Candida albicans
TNLKYLELQYFDPIWQTSIIPLTPCITRQFILPNHKHIDSAPVGVILTHRTAIYLRLSLGTGFSLGEGILVNSTTLGLSLGSKITFKLTKQRMIDTTVGCYLYKDGLSARVFGYIPTLQVTPRARNILYSRKKKRVVIDHAWQELKPKKIMTDSKVRTLCDVGTSEELQCNTKTGKHIDQYGNSLIWNHR

SEQ ID NO: 25859 - protein, 268 aa, Candida albicans
FARRWGRIQPIISPVSTNIEEFQFENENKLAPEPKTPPQQQQQQSRSRQPSTRTSPIRKFLHDSSPKRIFKSRSVVGPHFHKHSNSTISNTMSLKSSFSSSRSTSPNKLKSILKLHKHSTSVPNFQFHDNSWTHSHPHQQHSWYLDKHSFHSSHHLKVIAEPIDLWDIQTTNFDINDVYEVQPFALAQPPQISSSSSAQPKQKESRTKKVKNNEQDKDDDEDDEDEHHQTNQESRISSLPSQVFGEYDKEKWDTLKTLGNENSHTVAV

SEQ ID NO: 25860 - protein, 60 aa, Candida albicans
LIVVWLFPVRDIVLNKSTTTYNILGVNNESKNKKSSLAYEMQNSYDTHKNFFSAHVQFYF

SEQ ID NO: 25861 - protein, 74 aa, Candida albicans
LYSHSGYCQTWSPASRILEEKSIEHNEQVQMLYRVLYNQKGFIVTNSDYFWKRYLVNTRLTMTGTKTFGFKEKN

SEQ ID NO: 25862 - protein, 75 aa, Candida albicans
RLCLCVLGLVVIEKRGKNGNGKKIKQHDRAEDRTRDLFGTYIHCWKCKRNVIGRYTTQPVVGRIIFLGLYIVQNV

SEQ ID NO: 25863 - protein, 60 aa, Candida albicans
LSDSIQKLKSTNLLHYILLGINQFDRNLVNFQRLIFIGTYLYTQTPAYASFLNEAFPMHQ

SEQ ID NO: 25864 - protein, 90 aa, Candida albicans
SVYTNGQGAIRLANTSLLEFQQLNVTLSVKTIQHMAQTNFLQNTNKYVVSCRYFYCKINTVIKYTNTIFYPAFQESVKINSLYILHDIKT

SEQ ID NO: 25865 - protein, 66 aa, Candida albicans
LTINKKIPLLLVLVFSPIIIFFYNKQLLRTIIKQHKYKNLKKERNVTFLPLHFTTTDSIILLLLHC

SEQ ID NO: 25866 - protein, 168 aa, Candida albicans
LFVALGISTSDTSIVYTGLHHDLIYICYYISLFLTFVLFISSYFVFTFYYLFYSALHLYIYSLHLHITYTTTVIQYTMSILTTITNRLTNYTTNFQNNKLNHQPNIDEGTTVTENAYGLFDLFLYYLMNLILFMVLFIDLIVEFIKNCVHNYNIVACSFKHKLYNNIN

SEQ ID NO: 25867 - protein, 90 aa, Candida albicans
KFSMVPNLIFHNSLYNLQDDVYLNGEKIEFNQPPKDDDEPNLRINIEFTPKEDINGSNFAFGNDFTYPIRDYVPRWVIEYRFKAFQLVHQ

SEQ ID NO: 25868 - protein, 188 aa, Candida albicans
MDPILHLVMTLHIPLEITSPVGLLNTGLKLFNWFINDSVKGDPYPDKPYLYGPGISSFTYMAIKNPDDPTVNTHSKKAVENLFQQEENIPKEPNSRKKFFSNKKKCEKFTFKKGVTYILQFDTNFVKLADSKYSISIPRFDFDVSHYANDTLDNVNWVFKEGGYEGVDFGKLGLIINFKVLLEDSEDS

SEQ ID NO: 25869 - protein, 71 aa, Candida albicans
EMKRELRSGWNGIVLLGEKQEQGENFPWIQLFEQSAFFAEIELIQLNYLRLKFNGLMSIIKVSETILVVNC

SEQ ID NO: 25870 - protein, 63 aa, Candida albicans
RPNNTVDIIARFEATLYKRKRIKVASSSDITNFYQRVLYKTYYIIEKKNQPQYTVYVQLIMCV

SEQ ID NO: 25871 - protein, 97 aa, Candida albicans
QVMGSSSPLCSESWDPPPNKMLARENKTNRKSLNKELEKKMRATIKPPSIFPAIEQFFFQFFLLDLLFFFLKKFHYYQLTFDKVINQSQQSQCPQIH

SEQ ID NO: 25872 - protein, 63 aa, Candida albicans
NLLRVVFNKYQVPMITAIKYNLVIGSMASSFVVITRTSEIINQFVACFRLPFHSHFISLISAL

SEQ ID NO: 25873 - protein, 200 aa, Candida albicans
VPIAPAAPPAVVVPFKKKFPTHYIPDAIMKEYEEEEAKGTPSFGLSQFQPTKKNIVEDLELKFDLQNSKPLPKILSLPENAKYWNQQIIEEEKEKEKETEGEIDEIERERERLSCYRLPSILEALQSWIFLNVYHNILNIDTFTFDDFVFAMGWNADQFSEDGRCELLDEIWCAVLSAIVSNELPTNKEAKDYKERDEIY

SEQ ID NO: 25874 - protein, 529 aa, Candida albicans
KPMSHQPNKKSLRRKPPPIDDSTPFSIYQNLTSNPEQYSDFQVSLSKSPPIQVNTFVQSSPPNYIQLPPSAPPPPIPVQRPEYTLQVGSFPEAASAPVDQTNYNVSMSLEFPFDESFISMGGSPKPKGPKQIWEYEDDSIISQPIEYVRHASINSTDYKSRPRGYQQMSTTSQSAPLDSIPYPIEDLLPIQAKPTTTTAPYPTQNFEDSIDNYYESDYDYTFEDDSPSQMQSVDKYGNGVSPRIDDVPDLTSKRSLLQLAQSVNTLWQSHSQTNLIQSGANLVGIQGQFPMSAPPFLESPPRPSLRQLATKNSQNFPPPNTQAIDYALDLSYSRSPSPTRRTIDRTKTVSLGFTYAESEFIEDFSEGYNEFAVQHGPSSRWNSVNSNATHTPENLFWDDGYQLPTESPATEYFDYSMLPELPSVKPLPKSPSYLPEVLVLKQQQELPSLPLELPDLPFSSAFLQSQHFEICSKIWSLSELFKWCLKLRIWLNNLTISKTELKKALGGLLAFHRRDVPLDVVSTMAAGAF

SEQ ID NO: 25875 - protein, 61 aa, Candida albicans
IDFLWWWLSKGFSWLLVYNEVKIVEYFSSKCEHYIYYVKDGIDYLLMQFSSSYFIVSFLSL

SEQ ID NO: 25876 - protein, 74 aa, Candida albicans
SDFGDAIIIMGEEFCCIVEVECVCVLCKLLFLFLYIKYLFITVVVIVCLALFFLYYYKFSYIIRILLLLLQKNM

SEQ ID NO: 25877 - protein, 61 aa, Candida albicans
VKITARFICREIIVGVFIELLKAILNPGNCHSFTTNLLIHILPSRLTGVPPETSVTTKCCR

SEQ ID NO: 25878 - protein, 63 aa, Candida albicans
YLLSCIFPSNFFFLGFQFYLQKICYCSFVLLYIYQKENSFNIQFWCDLKLFNRYYISNTGTGS

SEQ ID NO: 25879 - protein, 241 aa, Candida albicans
KINKGQPANVSVAQQRDLQHQVHSHSQNEVRQYEIAELWNSYLKQVLFKRILLRQEINMFQNFMATLATSNNQPNTRHNIAESTVGTSSYNESSILAPLKSMRGEKSVVSSYCSHSSRCQSNYSSSDKQDTASVYTTGSSESNLETKEYNYEDEEFNKKVLNRRSMLGEMLEYLSEEDDENVEDDESVASLQKTYSIVSSGKHSDVLLKTYGTVIRRSNSKPSSPLKRSFGLNHSLSSIVS

SEQ ID NO: 25880 - protein, 63 aa, Candida albicans
QQLYIYKMDKCQYSTSNISCNKPPLLELSVIADKMQSNKSLITFSSLVVQKNQMIHHRLCTSL

SEQ ID NO: 25881 - protein, 61 aa, Candida albicans
NERVVELMLPRLIPRTTLVERGQLAPRQYYIDVSDEEEKDAGEEEKDAGEEEDNDYESDSD

SEQ ID NO: 25882 - protein, 76 aa, Candida albicans
  UNSURE (51),(54): Identity of amino acid sequences at the above locations are unknown.
IQKRRSGLYAFNKISLYQYSAFLVFSIILLTQIPVSDTTHKFKALHNSTIXLFXLTNSKGNADGTFETNVVVLWNW

SEQ ID NO: 25883 - protein, 63 aa, Candida albicans
LKAHKTAKTWPYNPDDRLYTHNHNFLVMLYLLKTITTMNFELVLVIAIYHKDQTCTLFIAYKE

SEQ ID NO: 25884 - protein, 67 aa, Candida albicans; identical to SEQ ID NO: 24922

SEQ ID NO: 25885 - protein, 218 aa, Candida albicans
ELSMSNIQFNLCTTFPGLLQTYHESLYDLITTYDLYLSYKRRQMSLLFNLLFSSAELPSINKLELSWMVLQNSIMTKNQQLWVYRRILNETMTTMITLGYISKKQLFELNHCIVLELQQVEDKFEDLIESETKDDNTSNDRNVITTTTINDDNEDENDRCFELLLLDKQPELFRDILNLHNSLISKYYVVQRQNNSHKNNNNNNTCSSSSIQRKCVYI

SEQ ID NO: 25886 - protein, 60 aa, Candida albicans
LVNIMLFNVRIIVIKITTTTTPAAAAVYKENVCIFNSIQFNLVFSIGVKKKNLISYVYFI

SEQ ID NO: 25887 - protein, 112 aa, Candida albicans
CKMKHCKVFVCMSGESRVMMDNFCMVKFFFFLFLFQHQQLNGKSPSFLPSFLSIHHLQPLQNMSGQQLLEEARKAVTNKQYDEAEIKYKQIINPSESSTSTTTITTNHTKKG

SEQ ID NO: 25888 - protein, 72 aa, Candida albicans
KKQKSPPVNPHLFDDETEEVGDSEESSLSTTPSCSKLVSLNDRKRRQSRGGINISISKDMEVHEPEEKKLKT

SEQ ID NO: 25889 - protein, 65 aa, Candida albicans
KMVPDFAKLNNYNESVCVVYISFPWVVSYLEIGHCLKIRLENKIKSAACSYQRKISNRYQLSVVK

SEQ ID NO: 25890 - protein, 60 aa, Candida albicans
FETNILHLIMLAKIIDPYSFRKCSYVLIYTKIMTSQSISFSLPDSFRIKDAVHAIMVCKL

SEQ ID NO: 25891 - protein, 152 aa, Candida albicans
  UNSURE (152): Identity of amino acid sequences at the above locations are unknown.
TCLYTYFIMKPLFTYKIPDSPHWYIVITDTSHHFYFNNHDKSSYWQLSDIQEHYKNDIDIVKRLIKSINFDELAILFDKSRGVKFEKIEDELESIEVDHSKEEVQPKQTEQQQVTEEEEIVVVENIPSKVTKAKPKEEKQPLTKQITSIILX

SEQ ID NO: 25892 - protein, 61 aa, Candida albicans
RFSSIYYVKFKLLHNHTGIFYFILLSFEITYPPTHIPLDVKYISNPTPQIFFYFPSQIITY

SEQ ID NO: 25893 - protein, 66 aa, Candida albicans
LVVVVLEVDVLLSRDESLVIELLDIDVDNGCDEFSISDGGERGVVVVEVEVVVFIGETGDIGKDMV

SEQ ID NO: 25894 - protein, 64 aa, Candida albicans
DSRCIFTTIGPRRNITKTFYSISLYCLVERRGGRGGKGRGEEYTVMHIWAGGKNGGEEQEQTEQ

SEQ ID NO: 25895 - protein, 70 aa, Candida albicans
QVFFSVFNLQNHTLKDTYFPFILYPVYLNYSLSNLVYYNLFQHSVNSFFYFKKQITNYYSFFKVKQKNSN

SEQ ID NO: 25896 - protein, 65 aa, Candida albicans
RLIHFKLFFITNLFLFISSILVIALKVVLTDGYSDSKVIKPRLCKRNSSSTVEQIGSKWKEKYPK

SEQ ID NO: 25897 - protein, 63 aa, Candida albicans
QQLANKIEEVGRYSEINATSTYHEIGDTNKNKEQLILNLKNHTKLSEQKKKTNLLVYDLGSTV

SEQ ID NO: 25898 - protein, 85 aa, Candida albicans
FHILLICNIVSPFRYQRVSLLFGVSHPQEHFISHTRVLILINHSKYFHTITLSQRGEKIEIPLEAFFFFPTTKTYRVNQMKTIQY

SEQ ID NO: 25899 - protein, 64 aa, Candida albicans
SYESTSPVRLRRATKKKKSRVKNHSFKVVSPSITTSYKQSTQFLPNKSKWLRKYFSLMVPILIC

SEQ ID NO: 25900 - protein, 64 aa, Candida albicans
DLILVNESATNLILTTVYNNYENTPDFFLGYEFFFCYPDKLFPELVPNALFTLTNPVFLDNPHY

SEQ ID NO: 25901 - protein, 94 aa, Candida albicans
IYLFPKQSLISNSIYATGYIFFLKKNTITNGEHRLGMVRSAIQLLISINQLSSLQFFSAYIIFINCHYKEIKKILQERMGKRIKTANHHITFVY

SEQ ID NO: 25902 - protein, 155 aa, Candida albicans
YFPNISQYFFSISTSRPLFPPAFLFLPLCKTTMNRISSISGLTPNRFLQQVWSNKLREFPHFFISRQFITSSINHKSKMTNLQKPNEEPKRFGLENQVKRNPHPDFNKVENSRPPFDFENTWTYTHIPNKDWKVGSGANYPSWKDHKKLEIDPYG

SEQ ID NO: 25903 - protein, 74 aa, Candida albicans
RHCNNNMSANRISPPMSYMPAVKLAIDDVKSGKVASLQEAACNFNVCLDWLLLEITNRSPDTFVNVFNTPAKDP

SEQ ID NO: 25904 - protein, 83 aa, Candida albicans
NIHHLDINSKVFCDSIYTELWGIFFFNNYLTLRFIRTIVKFIREIPSYYQFSPDYVRVCKKRLYFSNHLPYLHAYLINKIKTS

SEQ ID NO: 25905 - protein, 81 aa, Candida albicans
ALGSHLIRKPLITTFIILEKQNSGHVKPLPMLENIKLSHKFQNKSQVCRVKLVVFQMFPVIGTSCNANTLRVVHKEIKINK

SEQ ID NO: 25906 - protein, 70 aa, Candida albicans
QHKNKCMYRQIRIYNNINHSEIVIPREVYISGCRNRLDKTQTYGLSIFYIDSSPKCRVFFEIFKNHFHLL

SEQ ID NO: 25907 - protein, 60 aa, Candida albicans
LYVMQSVFKKKIGYWTFLLNVEENNLTNMSGRKLVKLTNLYNVRLIAIIVRFISLFDCLT

SEQ ID NO: 25908 - protein, 69 aa, Candida albicans
VECHDYTTDFWWSLAGRCDYKDDQVHIINGKYEELLLKLPIKNLLVKISGINKYRTGVLRLPGQESSHP

SEQ ID NO: 25909 - protein, 440 aa, Candida albicans
SFKYSVYTTCGTHLLSMSFVRNRNNKRQRTGRGPRKPKSNRDKEERQLSIRNEEGYFSKATKLGSSNEFVDFETLIQPYLWTTVTPVIESATRTHASARMPTLKRLCAEQLARNVEYIGWHLIASAPWSIWKLVWTIIVKTGQDSPETYAKFAKFFHSFQDFRAHRYLLEQGIRGQAIGKYLIPGCRLHRVETVFRNIDLHDTIKFLDIWQPITILDLSLIKLSRDEYFALFNIPNLVCLSLCNHHIDDTFIASLCSTIKNGKLWKLSVLKIENTKVTKTGIMSLFALGKESCDLACIETDIPIVDNYACSTNWLKLDNESALIYRLPLALKLNALMKKNILQTSIINDNIMDLMVVDKTWHSSNASQENINLAWEARKDATIKRYRGKTYIRKHELQKVDGPNGINAVSSTENTLLPTEQRRKKHKNRIQLNAKNFFCI

SEQ ID NO: 25910 - protein, 67 aa, Candida albicans
VGFVEYIVVVDNYYIEILTSSCNDTVLEHTSLQVDACPVPGELKYGCGIQKNRGTNGGILFPTRSYF

SEQ ID NO: 25911 - protein, 705 aa, Candida albicans
FSCWGFTLHFNLHSTVYDMSLKPTKKPSGEPEKLKREDRDKRTFNKDASPFSPSEYSQPSDPSELTYQPPPSPFQASKPLIRKSTTNASPTSSYASTALYEVILNNIPNSISQNDLHQFIDSCIKEDHFHIIEFNKGSTNTSSNSNTTTTAVLKITNLLTYHKIKTNLSQAELEGNIIEVKLKETDTPHSSSASPVPDPHFNPQFVPPLQAFPYWRQVPFSHRNSSSSISTSQRVPSSSSNRTSVDSRRTSSKTSNSTQSSISSMGTSQRSSTASSVGNDLLFPKKPAPPFMLRMAQNRDRNTSSPESFVSNTEDSQSDTIVQLEQYRRLEGPELGQGPGPGQGQEPKLEQIKEKEKDKEDVGDENEYEDEYILIRSGDGENPDEVIKVNPKRLFIGNVPYNSTWTSLKNFLITKSLELEPDNNISIHRVEIPTQQILRHDPYFLYHQHRGQMVGGPTFINKSRGFAIVRTGDRESSEKLIQMFDNVEFEGRLLTVRFDRYPDFNNYTVQQMYGGGGNNSSNSINSGVGRMFPMPPQFPIQQQFYPHSPTLDRSNTRHHMSQTPLPLPQPYQQQHHHQQQRPQQQQPSSPSVLSSLAFEKNLYQHNLYYGSTGTGMPSALVPPPGAVPPLPPPGAIHPSYGQAMMSPNAIAQSARTGTVESPRYQQYQYLQGILPTGYQQSEVASSGEQNSPICTTIFLYATTIF

SEQ ID NO: 25912 - protein, 62 aa, Candida albicans
IWHVHKVTFKSKVIGIMSDELGKVCDEILDETLLKFHKYGIPQVESSCFTPRPLAGSELENY

SEQ ID NO: 25913 - protein, 66 aa, Candida albicans
LKLVTVAETSRTANSKELLQKFIMLKPTRVIQAILFVFVLHQNVTVQTLLMRNVKLKLLYNPMETC

SEQ ID NO: 25914 - protein, 84 aa, Candida albicans
SEIKKLKAELASSNTKITQLDQSTKELSSLKSNESQYVAEIESAKQQLSKKIEEYSSIEADYYRLPTELIQMKHTNTEYSTQNN

SEQ ID NO: 25915 - protein, 67 aa, Candida albicans
AQNRSKIDQNFVEESNNLYSIVLSQFVLSFHFLNSVKYIIVRQNYPVLIILLLRASNLILFKFHFPK

SEQ ID NO: 25916 - protein, 66 aa, Candida albicans
TLSSLTSLIKLNEFLLTGGASNPNLECSSFGCIKLLLLVELTTGLFPFNEESEGFELDTPFFKPDC

SEQ ID NO: 25917 - protein, 192 aa, Candida albicans
LLYQIKKLLILVIKIRLNSKTPTSSPLSMKHDDSPKTSVEEKDDDQHQTSNEKANNNDIIDDQVIIASPILESAYRIKSQRSENGKFTKQNRPISMSFKGMNAPSFTGKLKKEALRSSDSHQSFNINFNDDDDGDDDSSLSVGGGFGSSSEDEDDDAYSFEQGNEISSASRFYHTNDDYIESQDLHQGCQSR

SEQ ID NO: 25918 - protein, 89 aa, Candida albicans
YKTKIHHKRTIFSSVLIFFSEISALDCLMCLWTAVTEQLEPIQHNNIEDHIFELYSERQLQNNLGYVDRTANEITVTLPKNKIDLNITQ

SEQ ID NO: 25919 - protein, 65 aa, Candida albicans
KINAEISWSQTLSLFQVVDIDVENDLGYYSCYFPNANSFSMLHSKPERKKSCDRNPENKRKTKKN

SEQ ID NO: 25920 - protein, 65 aa, Candida albicans
YLVALLGSFSKNTGLLSCLASVFRSFDDVRKWELISEDELSVAKLLPVPLLLLVVVSKSVSVSLG

SEQ ID NO: 25921 - protein, 87 aa, Candida albicans
VVLKLSVGGTKRKMLKKNKLKRRRRKRLTKKSKKIVESYRLRHKQTNKARIEKIKKKRNKKRKFLGCALSFVTLFFFLSFVLLFNNR

SEQ ID NO: 25922 - protein, 78 aa, Candida albicans
DVATFAWIESKLRLLLYTVAQLAQISTRICEGKDKIATYLSFPIDLKVTSKIEKVNLKLTFKITSVMLRLINKTHTLT

SEQ ID NO: 25923 - protein, 63 aa, Candida albicans
WWGFASRQKQEVDTTSSHKELIILPTTTSHDRLIIVICFNYTKSRCSTIKSLSYTTTMCVGIS

SEQ ID NO: 25924 - protein, 73 aa, Candida albicans
SRQISGKILLWGCGERTSQAILECFPVRRKRLTSIYMVTDYNQLNSTPYILASRNFRNEKGKTDILRYLQGGL

SEQ ID NO: 25925 - protein, 126 aa, Candida albicans
WIFQPRRLKTNVLRESEPSLEKLTKSQMIEKYTKDVKMLKSRICFLEAMNARLQFDLNIATAAAQNKKPEGVSSAIPMDENKGFKQVMGYIKEIRKDPIKKRRRKALGDITNTSKGSNSYTNFSGS

SEQ ID NO: 25926 - protein, 64 aa, Candida albicans
FCIKTTIIIIMTSLNPLLIVFLMCHDYTNIIQKEKSKKKQKPTPESQKRFIKENNYQKLPLMLN

SEQ ID NO: 25927 - protein, 282 aa, Candida albicans
EWNFIYLAMSFNRVETFILHRIFVDLNKDLFEKITQEPIVSRVKTGSKYIPYEYIVQSPTTTILKNQIAVYNAISEKIQELPITENNFELIIYGLEYQYLHLKFRTLERKDVVDIIGYVISTSDGKFGITNLVESIQLIIDPKLRVVVDDFASFTKTFPNLTKTSLNHALAITYAYGIFFYPVVHNVLNCTKNVKLMRDFMRYYYLRYLQNPNDEFIDITQEAYNFCKENFPNDIEQKTNQVIDEMTLSVLSSTLGLLDSLETSKLEYKHRRIGYQYTRGSL

SEQ ID NO: 25928 - protein, 67 aa, Candida albicans; identical to SEQ ID NO: 24922

SEQ ID NO: 25929 - protein, 364 aa, Candida albicans
  UNSURE (23),(28): Identity of amino acid sequences at the above locations are unknown.
YFIMTEKLLLPIPNFRLFCELMXKWTIXFNEEGFNVCQKISLILPYNDILIDKLTYDVTTPGTYCIYSPLIDGYEYRVDVEESSIQFDNVVFCVVNIIVNLFYNQFFSRQNKVLFKLIGKFELIKVGIFAVSLLLSLRFNIINYTEDIVSAVDDVFTMVFLMGYGTLYSSYKDQDIGKIVIVTLFTVTPAIASRFFDLKLDVTNLVINNEYYNVVDGVLGSGKFDGLSVVQRIVRDVKAHRFSAAVAALFGVSKLVKFTMYITTIRQTLNKLTPGGTKSGYIYTVVLWLFVYPFASFAFYPDLVYNYYLVTDYGLVLKQFLLESVRDKYIVLMADECHWVLIFLIWFVGNNGLTVEPTSLKKDE

SEQ ID NO: 25930 - protein, 74 aa, Candida albicans
  UNSURE (25): Identity of amino acid sequences at the above locations are unknown.
IFFRRMILIIHKRPWVKWWVEPPGXMEIMLLGLRITFEEPFWKHLLMFPNIGRINIPLIIIIPIHKTQRRRSEY

SEQ ID NO: 25931 - protein, 63 aa, Candida albicans
TSLLAQQTNYFKLVMQSVLYLSRLPRLYNTTDPQFSLTNSLDNAVLYPRIINKAFLRLYCFKY

SEQ ID NO: 25932 - protein, 75 aa, Candida albicans
DTIDSYPWRLFYMLYVMLMEYTNCLILSQKRKLIEYYYQFCYILLYTLARKRKLEEIKGSVQLSIFQSRDCLISG

SEQ ID NO: 25933 - protein, 160 aa, Candida albicans
HITYKTNAMGNCLSCLIGNSNDDDYNETSSLLRHQQQHNQQYLSDYLQEEQILKQQQRQQELAGIVNELNDNLIDVTSFLSGNNNNNNNNNASLGNSGILANESNINEEEHTQVGNTIKSLPYLYTKEDKDEILKKLSDIDADVKQSFKIQSLVPLYIKF

SEQ ID NO: 25934 - protein, 88 aa, Candida albicans
KKKKDLKQTHNIWRIRKFISEENSLHGDTKKKNGSEILSRRLNSLPQKKKAHTYYLSIIPNKERPKNSILPFNTFQNDERNIPYNQIT

SEQ ID NO: 25935 - protein, 62 aa, Candida albicans
  UNSURE (15),(16),(17),(18),(22): Identity of amino acid sequences at the above locations are unknown.
SRKNKRPRIFSGKGXXXXVNAXFDTKRVSLKKKKLIWNLRITGYFPFKNKFKYLPNPLSKKK

SEQ ID NO: 25936 - protein, 60 aa, Candida albicans
FTITLMSEIGGMIVNKHILLNSNNKDVNYYICFLGSFFFVGLGDLFTDDDNICLALNHTM

SEQ ID NO: 25937 - protein, 61 aa, Candida albicans
LRYVLSKFKLLLDVIFLSKIDFTHSLTHSLTHSPSPPLNRSHMILVPLNIINNYHQLVELL

SEQ ID NO: 25938 - protein, 60 aa, Candida albicans
LTAFWKNMHKFQKHNLGSLQDYHLFILGYYSPYPFHPNYKKLEIHFYTRSDITTTQFNFI

SEQ ID NO: 25939 - protein, 69 aa, Candida albicans
MLILSESKNNLFIHSLHYITLHVAPSKIVVVKKNAFMYVCLAMSGLKCNKSVFNCINFFSRFATEQICV

SEQ ID NO: 25940 - protein, 112 aa, Candida albicans
ILALFGLSVVLSLCIFFFCRCDVLSRITLTCYSRNYLYHRPEVVLRVNMKRTRFRPVGCRNINGDAINRGKKRALFFHYNSLQFCNKIITYLVTLSFVLFLFYLLQRVKIQL

SEQ ID NO: 25941 - protein, 101 aa, Candida albicans
LIYSLNFLFYVIYLSKTTYFQILIDDIFDELGQLFTTFIFGRENWVIGQNWNRPQPYPKEFSFFFVIFLALYFLFCNVTYLTHPPIKFNHIVQLVIASLFD

SEQ ID NO: 25942 - protein, 89 aa, Candida albicans
TQVSPAIQEDLEVLGPKFSSPREEEKQCSPTNSAPFFQMAPVFFFMGPALWACTEGYVPPAKPGILVSSNRTRPNRGPYLLVGVSPGIR

SEQ ID NO: 25943 - protein, 182 aa, Candida albicans
SKLPLYRSNMTSNNDDNVNLEKLNISDEIINDYDNGSQEQLDVLEAYQTDEDKQEQEQKEKEKDVELDNPDLEEEVGITMNDDEGDHKLNNQKIDDEINKEDEKDVKASDDYDDDDDDDDFDDFNEASFQHAPTIGSTNQENGHDEQDDDDDDDDDDFGDFDEFQVSQPSPTTTTTTKNNNL

SEQ ID NO: 25944 - protein, 86 aa, Candida albicans
SINSSRMEFIEHLGVKLEEDDQEVRSFVIWVKGILCLSALLIYIMIYQMVAISCSLASIVFPDSANLIRNKCGYFFWDFSLYLMVR

SEQ ID NO: 25945 - protein, 81 aa, Candida albicans
ALCTTLNVVAVFLLNLLGMAVDRDEMDRVVKKKIFLFNARVKNIFTNPIHYHEFYVNVLISFPNYLNRYLYIVLQQEQKHQ

SEQ ID NO: 25946 - protein, 71 aa, Candida albicans
QYPTVWVLIPFVMCNLAQQTRKKKIKVRSTQYIFLYRLVTNHHVDLNFCDNHVSIEIITADPSPKERPALR

SEQ ID NO: 25947 - protein, 176 aa, Candida albicans
  UNSURE (148): Identity of amino acid sequences at the above locations are unknown.
TFVIIMSALKSLQQILPLKNDQPLDELNPTPISTELSLEHYRASLQQSNNENLAKCVSQFESFNHKIKEHKKKLIVVGEIIEEFSNELNNLSSSLISLEQQSNSLSKDSKLQRSITERLNPVILDLMIPPEIARSVLQEDFTPPLLGXLEIYHRKKNNSPILCPKTKSKHRLKERI

SEQ ID NO: 25948 - protein, 63 aa, Candida albicans
ELVLFCTIKVCRFSNICGKIYYPKNDHVTTNTGGDDRGETRRKKQQASKKKGIIQLTSILNVL

SEQ ID NO: 25949 - protein, 88 aa, Candida albicans
TEARLFNNNSNTSCFKVYIVDVLLDCLVFVEDIKGKEKLVSKKKGVLCCISNGLAVVDRCGIGFHLGEVEMVMAFIAQERVEEEKKKF

SEQ ID NO: 25950 - protein, 63 aa, Candida albicans
DCASNDEQIIESIESDISSEERIRVCRLVTLLSVDRHKSRRDNQESEWYINILPSINCQMPFI

SEQ ID NO: 25951 - protein, 154 aa, Candida albicans
SLMINTDTVVLQVMTEKQTAQYNQPPQQQVYAQPRQQVYTQPTTAYEQQYQQQLYEQAPQEGLSYQHQYQQPQVTLTHQKQYQQLQPMQNQQPYVQPAPTYQQSQTPKFCNFFLFYKQLIALLLTSKNFFLFCNEKSHLESSFKQDEQPTWLQN

SEQ ID NO: 25952 - protein, 82 aa, Candida albicans
FNLWFIFNNCMFHNLEKDSLYSLSLIFFTFQFLSLLFFLTTTLDKVLDGIIKLIELQSAALVMCLSLNTLYNSSKFGAGKTN

SEQ ID NO: 25953 - protein, 679 aa, Candida albicans
  UNSURE (5),(6): Identity of amino acid sequences at the above locations are unknown.
IPLSXXGSKHNLQSINPDSKTFTIFLKGIKKYFDNEMEKIMINNNSPTISNNERIIRLLDIEAGHIKTSQKIFERAKQLALPPLPTTSNNGDPELDSFNIHKWNKEKIELDSPLIVSYVSLLCNGGGGGGIITNSTTTTNSKIKIKIKPPIGSHYLYNEKALSILKQSSPEIDSLLKFVQQVIGEQEEGKDIDTDSPIVAKKSFKSRIDRKINLAIEQAIQSNIKLKFNDKIKNLDPYKIANLINDKNFNPEVIMSTKNSKNFNGLQPVPLIDFTREIGRENNHGMTKFLLMPLFDSLTNMGKLNEFVIAFWYAMIKWGGLRINLSIFNNNNNNNNNNNNNNNNNNTTTRNVLNGVIKDSETLSVSNMAAGKKLDRSVIDEVILGIFINKITEYGREKGLTKTHLIMELFQTLISKDLNPLRPCLVGKDKDKDRIQIQFKYLMRTWWAIHDDLEYYHAYNQNNNNNNNNSNNNNNKVDDKDLRFIQLEQFLKNLIIFNDINYQWSRNLLMKKLIPDEFIDQINRILIRLNHLNWFNIGNENENENKKIYLYKLMLKSSIKLLIPQRFITAKKNGNGNGNTNTNTLVVVSTYPKLMEQEIFRYIFVKLSKTDNLTDNNIKLLMALKKYRKAKPYNDEEAEKLFKETTNAIYDAIEIGDTKLTKSDIKEEEEEEEENKVSG

SEQ ID NO: 25954 - protein, 71 aa, Candida albicans
ECLLHVMLAKKKKIFYLTFNPNTRQTHLGFKPVFWNNPKNLVGPTSLAYLNGVYCRGFVSVVYVNAPLCDF

SEQ ID NO: 25955 - protein, 82 aa, Candida albicans
LCTTYNPLHLQTRHSLFSIFFFLPTDQALELPLMKRFIIFYRTVDSLAYIFTLSRVCPPNNHFGGCILYDEEENVNLARPRF

SEQ ID NO: 25956 - protein, 65 aa, Candida albicans
LLLAVVCLNKTNVNNDALDKNRSSSLITISFLHLGNKKKTSCIINQFQQRKPRIPKYLLNSRRRV

SEQ ID NO: 25957 - protein, 74 aa, Candida albicans
  UNSURE (2): Identity of amino acid sequences at the above locations are unknown.
IXSAFNSEKSKKSKNKTKEKIKSQQKFFLTPHSNYFSLFLMMIQHTANRVYNCKIISYHSSIIPYWLKKNCCVC

SEQ ID NO: 25958 - protein, 64 aa, Candida albicans
IHIFITNHLRGPRLCFKLMSHSQINIRGMSLRQTESGSMGDIQMNTTLKGILFSSRKLPEKKKK

SEQ ID NO: 25959 - protein, 90 aa, Candida albicans
STKYFHNLLYIQIYLCPLLKSCKLCECKIHGFLFNNIDYDYWVNLPKLKKVISFRSMNITQVYNNKSVYPSPVNSCIETMSSTAQGRSLS

SEQ ID NO: 25960 - protein, 60 aa, Candida albicans
KVFSAKGYEKSKKHITSDFVLHIDIDIYTPAQPLINFVEIFVHSFNHSFIQTISNYDSII

SEQ ID NO: 25961 - protein, 175 aa, Candida albicans
LILLKFSFIHSIILLYRQSQTMTVSFNYQNNEIVSSPTVIVSGSTSTRLYRGVISFTNNQNKVFPPQYFEVNNGHFKAIIHVSPGERNIFQVDILDNGYINDFGFVEYGNGRRPNIVDSGSLTLSFNPLPQNKPIHLCLIRGRDSNNTYDMPKYRLQRGEVPSLHSRRLAGSALR

SEQ ID NO: 25962 - protein, 79 aa, Candida albicans
QYLSNASWFLGSIISMVVNLIGIFLSLGDFNASYNMNLAFEHSMQLSLVKNVNCTWELMVLYEKNLFRIDAQFVCLLIV

SEQ ID NO: 25963 - protein, 79 aa, Candida albicans
FKTVSISCSCKKSPTITFEPCLSSFMVVAKPIPVSPPVTIAILFAKLYDMIEYGMNKLSETTPNLVRYEIEFKGFCQNL

SEQ ID NO: 25964 - protein, 84 aa, Candida albicans
TQQVYPPLTNSHFVSIFITDIFTISYTERLHFFFLFGKLPLVIFFQSWGYRSDILIILGMGSIMISRVDYRIINQISPMHSIIE

SEQ ID NO: 25965 - protein, 85 aa, Candida albicans
IHLDSSFFFPPIREEYVFFVSSVRRLRGGHESVWGKGRRYEGAARLMLVINHNVLTYFFFFHHRIIMIIILENLNNEPKKIIEKP

SEQ ID NO: 25966 - protein, 60 aa, Candida albicans
DALLYIISVDNMVVFQLPFITKTQPNTTGLFTCKKKGSVLKNFKDGKKQPQLLSHLGVEI

SEQ ID NO: 25967 - protein, 202 aa, Candida albicans
IINKEMTDRFGRHKSTRWVNSVPTYGDWGDDDYEDDDYTYQEDNSSQQQQRKVTPQRFELPSDHVPPVPVIDEKYKNLTSQNNTESNVSPPKELVLSVDGQTNLESDSSDEESEIISQGGVSPYKEANKQTHGISHNVDEKLKTPAYQANIPVVASHDRSDYNEEDNNDFTRKLNEIQLKESNHADSASSPWAWADRSLSLQ

SEQ ID NO: 25968 - protein, 173 aa, Candida albicans
HTNREKSFIYILNMLLNTAIHYWIFLLSIVSSSWIKYPIEISSIPGWHKEPTDIKEAQNVCDKDSEINNDLYCYPQCFNKEDDQPKLDHCCFNENGRVLYVSPCTVEPENEATTTEVAADQTETLPAADSTSAATSTVTADLEKYPQCFNKEDDQPKRVFTTGLEGTGLRQQI

SEQ ID NO: 25969 - protein, 66 aa, Candida albicans
SEFTSNYLLFSWKTTNYILTELKRKIKPMMKKTRLQRLFELFQLRLTLAGKSKIKQFRYLVIKVSN

SEQ ID NO: 25970 - protein, 61 aa, Candida albicans
STSISRIFRLEIELFTLTMLWLDCLIFADIISVKVITKNSSGYFNNERTTNILIILNIHSK

SEQ ID NO: 25971 - protein, 80 aa, Candida albicans
SEAMPIVFFLRCLQVSIFLLGVVVRNHHSSSPTTNDQPSTSSCTPTWASLFENQAIVMLVKRSSPYNVRKAFCSFFYTYR

SEQ ID NO: 25972 - protein, 66 aa, Candida albicans
LIALYGNIYKRIFFSTKKKKNQLVVNKVLVCYRFLVNIDFGGTVSMHSKKKLSKTRNDPLTHDHRL

SEQ ID NO: 25973 - protein, 372 aa, Candida albicans
TTMIRLFPKQIRLLSYLTKTTINPVDFQLKIPEQFTPKSLLVLSTPTNLPQVMEDSIKLSQKQDLQMVVAVVDTVVPYSHRNGVFELWLDEPISIGDSALLEEKDDINKPPRESDGLYVVSAQKHWKNIASQLKINLRQEMELKLNLANTVFSTGSIITLFYFGNGLNLGQHLCDLEILLPRGLIPRHSSAVVKDNWTDLYPGTSFKVTNCVGNLLKSIDNNPAAKYLEENKKLMSIGSKETEVFVKIKKPNSTKVERFKVTAGGGGWGAKADIIALSPEAKLVKGSEIQFFMVTPEDRYLPNHNDDEVAQFTNAFTFTNSYEETSYNEDTDESQHIYENVFGAGSEQGFFFNDVKHNSPGESVSLKLEKKK

SEQ ID NO: 25974 - protein, 62 aa, Candida albicans
EEDIYVLPKPKKKKIRATIIATEPAISIVGIVKDGNSKKDMEHSEPFKKNEKELSLGVLIFL

SEQ ID NO: 25975 - protein, 273 aa, Candida albicans
KSIPNKNKRMVLLCKYKVSWVFVLSVAGSSLIRDFLFGQDDSLSIEKRTNEYTTPEYGGTSHCNGGDKNCYPQCFDHRGQPKKDKCCFDKHNKVLYPYPCTSSSSSSSSSSTVSSSSSEVISSSSEEASSSEITSSSEISSSSEVSSSSEVLSSSEIISSSSEVVSSSSKVSSSSEATSSSSEIISSSSEVVSSSSQVTSSSEVVSSSSEVSSSSEVVSSSSQVTSSSEVVSSSSEVTSSSSEVISSSSSSSEITSSSSEIVSSSKRCFSSSS

SEQ ID NO: 25976 - protein, 91 aa, Candida albicans
FVLRIDPLFQTEYYITFPKIICLVLSEKEIQRIRPNIRPTNSSSQQFGDTAEDYRSYFNENATSQENIYSLMETTEHVIDNLHHAAGRIHD

SEQ ID NO: 25977 - protein, 86 aa, Candida albicans
NLAMGVFGRGAASRISIRSIHLRNTANFVVPENYKPNRSLLKQLPWKAGLDIWWKSLSPNRLSDLQKDLVEFMLPSRFHQRGLEGP

SEQ ID NO: 25978 - protein, 91 aa, Candida albicans
VAFWLDFHGDNQLFPKRFWFIHFACQLIVNLASNKTSELKDEFHDLYIPIPFPRFFVIFIFHVMAADKQVKRFNWKLIARLQLICRIFNLI

SEQ ID NO: 25979 - protein, 92 aa, Candida albicans
SHATTPATELKKTEYADKYVVNLEEVEINFHGQIARAKNAQIYPPLLMFKNLGSKAEQSVPNDNELAEMFVPNCANAKAAEMKNTPARFPGV

SEQ ID NO: 25980 - protein, 84 aa, Candida albicans
LNNVFNPNSSTTNVLTVVKPPQKPSSNPSKTCNAMVLVTICPLPPGNLPLAKSVNTASSNVPRKLAVNVPSGKFETLLFKNLDK

SEQ ID NO: 25981 - protein, 66 aa, Candida albicans
YCNCISVNEFFKTLLDGTNMVPVPLRNSLHELGKGGNLVFLGFLCFFFFFFFLLCTCCSSVSINSS

SEQ ID NO: 25982 - protein, 140 aa, Candida albicans
SWKITHIFYYILSFFSPIYMVAPLVSESQSSSIEETDEQQQQYQQLARRRTIQSDLVDIEAESISSALPEGFNYEKKTTATRFLDKTQKYYPVILNIVHGAIWGVSLRKGLMLLTTYSGSFLSGVIWAQFCNMCGYGIGH

SEQ ID NO: 25983 - protein, 67 aa, Candida albicans
TFRKFHFFPTLGRRMNLASCILHFEPQKKDWYTQELLGLRINSLCSAGEPINDHDFLLIILACHPSA

SEQ ID NO: 25984 - protein, 99 aa, Candida albicans
DHLHPMFVNNTRYLLQSSSTASPSAIPSKDSSHGIFSISQEYTGLVIFFALCCLFVLLAIFYFQENSNNPLMLSTTYQELKQEYNSNHNNDNESNDNHR

SEQ ID NO: 25985 - protein, 88 aa, Candida albicans
VAYWVCALYNTEVLTLPLNDIHCIIDENSVFPGEKKVSQVEKQEEQGEEEDMGGGDDSIMDNSIEFIHKAPSGVWDLPITLVNDVLYE

SEQ ID NO: 25986 - protein, 66 aa, Candida albicans
AANNCLHHLLNILVHQPEEYNEKDQDQKNHLRPFHLSGSTSRGGDLGGKRRISLSLSESQPESESS

SEQ ID NO: 25987 - protein, 60 aa, Candida albicans
VYIYIYSFLLFINICAFYSLSSDFLIPALFNTLSLTVMLHSYSTSFTNVIGKSQTPLGAL

SEQ ID NO: 25988 - protein, 88 aa, Candida albicans
HVGHYRDILLGLVKKLMKVVNMPIISNQHSNLLLLVAWIRKKLSQEAAFSALSSIIEESDVSLIEFYLGTFITSFWLNVSKYINGKIW

SEQ ID NO: 25989 - protein, 79 aa, Candida albicans
  UNSURE (17): Identity of amino acid sequences at the above locations are unknown.
TTVQKKFNNDYNKAELXKPILDGFMRCSLFWSLSDVKISEFFLLQINCSHDFRFSVTSLRRKINKMTSFVQQNMHKVGS

SEQ ID NO: 25990 - protein, 94 aa, Candida albicans
KNRKRKCIIDLLYYKTPEVDLEIDVTVVINPHYEEGVKQIKTNYPKLYPITYEAVQSISKTIHFINQSPMLMMLSQFKDSINNQCFSGVLFNYL

SEQ ID NO: 25991 - protein, 60 aa, Candida albicans
  UNSURE (46): Identity of amino acid sequences at the above locations are unknown.
FCYLLTSWNYLVFLILPRVYSYNSIELYLINQTSTIMASFKLATDXPEWKKLEETYKSRR

SEQ ID NO: 25992 - protein, 66 aa, Candida albicans
NLKCNKWVFQTIAIRKKENHKLMYSSFSHMNFEFYLGAKVWLYCTLRAMNMSSQLLFQFTSILKFD

SEQ ID NO: 25993 - protein, 80 aa, Candida albicans
CNKNCIVMISHSTVPSILILNMTLVISNYGKRMYVDILKFGFKEQREKKKYSSPQKKKERTESKVEKLEIVKLRLFSKFI

SEQ ID NO: 25994 - protein, 89 aa, Candida albicans
DSRLMWMRKRGEKECLYLLEGLCDLIILESSPICYGKYCVNVLDLLVAIYGQNNNFETGIVERGVMLISMRQYFLIFATTNIGIYTDLI

SEQ ID NO: 25995 - protein, 116 aa, Candida albicans
HQSVLTVLLICIYHHTTLLLYIMSDFAFNNYCIHCDKLCLNNSVYCSEECKSIAYESSLNQLPHNHSTTSANASAAGYTSNVNSTKSNTPSWVFTLVNSKPYIYNYNNNNSNSIYR

SEQ ID NO: 25996 - protein, 63 aa, Candida albicans
  UNSURE (15): Identity of amino acid sequences at the above locations are unknown.
MYVCINPVCVILCVXLTQNNRENSTVKKRSSFNYRNRPRPKHAYTNCVYIYKIKSLSLSFFFF

SEQ ID NO: 25997 - protein, 90 aa, Candida albicans
LQALYIQLQQQQQQQHLQINTPLNISSLTPNTNYNNNEYDYDDNDDDELNYFDLNYSVQSNINYTTNTTKSNNELINSTSDNYRKWLTAL

SEQ ID NO: 25998 - protein, 183 aa, Candida albicans
TFYVTIDIPSISNKIDNEEEPPSRTGQAPKFKNNIIKPSAQLQFTDLKEDHPLVKISNNTISAQGSSSSSLSASKNGFNSHTHNSGVIDPSALIDGKIYQTDWNQLQGTELIFDENGQFIGKVKEHLTCNNNTKFTLKKAEEVEQLRSADDSIMDIDQDSQGQQPARSQFLKRAIVAARAKGK

SEQ ID NO: 25999 - protein, 63 aa, Candida albicans
  UNSURE (42): Identity of amino acid sequences at the above locations are unknown.
ILGFANLKSVRRDLPQCGSDMNENAPYTARVFPTDDFFSPYXVPCGVPFRLITFSLTYKSWFS

SEQ ID NO: 26000 - protein, 118 aa, Candida albicans
TDSCFSIIPGDSLANYITHIIIIEIKKTNKTQIKCCVLYAYVSLCVGVRVYVSKTKNKKKFRDFTFYTGKKRIFSQLLKTKKTKKKKQHPPIKNTLFPLQPTFQQSNQLSLGETRSLV

SEQ ID NO: 26001 - protein, 70 aa, Candida albicans
QCSTYKDFEDKTILVSTYSIPFCLNSLPKQINIIKSGSRALYSGSHFIIITKVRLFLGFSEYSINGKILV

SEQ ID NO: 26002 - protein, 143 aa, Candida albicans
SRIINRNKGYKIKVIIESQSAALVGFRFNAKHVTLYAVGYNNNFFLRLYCSLSTTSQPSIYFSRITMVMVGPSQYNTRGKDSWSLSLHSGSHQQTAYESLPNYSCRNVLQTTLFSVRHLLFSFLSMVLGPRPRATYSSWSFSL

SEQ ID NO: 26003 - protein, 73 aa, Candida albicans
IKTILYCSSNGGLSHDLYSEKSVSIIPQFLDDEFQSDIKILSPVILSLPVKFCRRIYLKTTTIYVIKLKKKLY

SEQ ID NO: 26004 - protein, 102 aa, Candida albicans
KQNTILYLVFTKSKSIPLIMVVRLRILVPYSKHKSLLFTLNRLLLYSSRYTQCYFFLICGNTGRRKHGDCPNQVLDCRLSIEMSIHVRGWGGDEKYGRERET

SEQ ID NO: 26005 - protein, 120 aa, Candida albicans
  UNSURE (117): Identity of amino acid sequences at the above locations are unknown.
FFTFKTSQWLILSYSKCYVFFQIFLKKFWNIFVRKKQIKTRKIWIQLMFELGCATWLIMNNKLALHNGSNCTEENNTLIYFIDGINGLIIQMDNSVHCEKGFPIIYKKKILKEIKFXYFL

SEQ ID NO: 26006 - protein, 64 aa, Candida albicans
KTILITYFKNDKIVGKERDFTRVAMLKKADTGDTKRSCKNGIKVATKSETKCSHKNKAKKKQLG

SEQ ID NO: 26007 - protein, 96 aa, Candida albicans
SINYKVWMSFSGVRMMIHHRHLRRKRKRKRKKSVRKLSLMKMKTKTKTKTKRLERKRIKKRNYRVINNMLQMQNVALGDVGSNVMQKIKPKSKNLF

SEQ ID NO: 26008 - protein, 195 aa, Candida albicans
RIFFVHLFNMALPTIESFKKLSSKDKRQVLDHLFEPCNTLSNFIFIKVLHQQYNTYPEFINLVRKELLEFLKQSETFQSQYQGEINPVINEIISAHPRLGEPKKETLSVHSNNEQKTLNNDPEIIKKLKELNAAYEKTFPGLRYVVFVNGRSRHEIMDNMQKRIERNDINLERVEAFNAMCDIALDRANKLGIKL

SEQ ID NO: 26009 - protein, 76 aa, Candida albicans
KKTTFTTKRCQIYLLHITINSTAFCKLNIYFLFNTSILQWYVSIFQLSNWLFQEFELLTVLFSFSGRSFRKCNKGN

SEQ ID NO: 26010 - protein, 75 aa, Candida albicans
MTVAFVQIETLNYILSKKLVPSVAIDNEGEGSLAWRHLENLVTSHLPFREIVDLPCSAYIDCYLFPAPQQYSNHK

SEQ ID NO: 26011 - protein, 84 aa, Candida albicans
SSGLLSVGKVETVAEEFYTHKVNKILAKILNSLKHHLDTPNFNYYSSHLLSLGCLCRGQDTAIMKLANFTFSKKNTHRHTHNCW

SEQ ID NO: 26012 - protein, 62 aa, Candida albicans
AALPHIIVFIPFIIVAPHYGYEDFKTQRTDNINYQSLLISKWLNSHTSATKLVETSKLCLVV

SEQ ID NO: 26013 - protein, 83 aa, Candida albicans
AINGFLSWSCLYFLIQKYQLNYCTVNADCYKYCDNDYESVRPVADVAVPDFVSVHIADAPAADDDYGKIDYSIGETFVAMSSY

SEQ ID NO: 26014 - protein, 66 aa, Candida albicans
TIEVWGNTAIKFIPRRNSKRKKRKRITKSVVMKFTTEELNFTCNRGPIYTRDISYFLKKLDNIQSL

SEQ ID NO: 26015 - protein, 65 aa, Candida albicans
KDFFIDWIYTSVLYINAITIRILYSIEKNSSNPNMLLLDLEQKTTNKYAYIFEKGIQGSRPKSIN

SEQ ID NO: 26016 - protein, 61 aa, Candida albicans
LFQNNTSQFLAEEKLDYATATLVLESEFYIHTTQHTHTRTMIFCEMSNQISFFFTPFFCIN

SEQ ID NO: 26017 - protein, 186 aa, Candida albicans
WCFSSSEERKQMGNLIDEQTWKNATTDYKNLHKLVENSHSIRSFAFKCQDVIINRSTVDNAYYQSAKRFLLIINLLGFGTEIRRLLIDDLKKIPNFHLNYHSLSPEEQENMVSHVKSIQKWATHYGINLELAFLLEFSEYIFTKQFIYNSHILYQLLKREEKIWERRVEFLRLEQQQYEKNRENHK

SEQ ID NO: 26018 - protein, 71 aa, Candida albicans
  UNSURE (64),(67): Identity of amino acid sequences at the above locations are unknown.
IKINYKEEKEEKKKRKGKGKKNDEEENKSIFIKLKISLLSKLNHIYSEHRGKKERERDFFHTAXERXAMGC

SEQ ID NO: 26019 - protein, 378 aa, Candida albicans
PKSQSSKLPTTMNVTSNGYYSSQYLSEQQRKQPRYQYNYTLNLPPSPKEFIVEVDEDDSAPYIPQMEFLPLQRQAFMNNVRPKTPKSQSESMISPPGSAHRSTSSLPIEYDDLEPDNQLEETITPAQLNYLQEQNHYVPYQPEPRQPYQPQQYNPPKPKYPKNKNNDYYIRQKKRYDKAQVVKPKLYSHKTFHDVFEDKTEKLDRYNPMDLVFEGKDTKDKLTFLEKMQTKLTKDKYDDYNYYDHRPKKSPVKEEIFVDNQSDDDEDVTQEEVEVAEVVTVGEGKDKETKIIKKKVPLKKLMKKKLNQAKKELGKDFVDYSRRQKEINEKIKESKLQLKKKRELERAAEKEKLRKEQKEKAGAEGKATEKTSDDKKGR

SEQ ID NO: 26020 - protein, 105 aa, Candida albicans
  UNSURE (9),(18),(19),(20),(22),(23),(24),(26),(27),(53),(54),(55),(56),(57),(58),(59),(68),(70),(72),(74),(75),(77),(80),(90),(97): Identity of amino acid sequences at the above locations are unknown.
KEKEREEKXTDGEGEGEXXXDXXXDXXAAEETSVPWLAYLASWLYYPDEEEGXXXXXXXGREEKEDDXDXEXDXXDXAAXPVQKVVYPPXPFEETTXRTKVFPRN

SEQ ID NO: 26021 - protein, 242 aa, Candida albicans
IGINKYITGNSLSITMHKLRKFISKNLSRSLKKDKKSKTNTNKLETGLFSWKKLGYTLLSGRGKVGLVGNGSSSGYGSSIYNINLNQNEEILINKNNLLGITVNGPYDLQNCIVKYEFPIINNANPTNTNINIKEPVTIVKPKLIQPTTWNLIVLKLKNFNNGFKKFFQIINKYTLGLKTTSYNYLAGNQDFIKVIGPRNLLLQSNTNKSHRGFNNIIPRNKPQAKVWPTNQSSPPSADQRM

SEQ ID NO: 26022 - protein, 82 aa, Candida albicans
  UNSURE (62),(73),(76): Identity of amino acid sequences at the above locations are unknown.
SRETNLSILFYISFAAKFCQKNKTIRTYQIRSRHLLCYNALIKYIYFIYSNHTNLFFHTLSXGRYILVLAIRXDPXDGYPRS

SEQ ID NO: 26023 - protein, 71 aa, Candida albicans
FAGLCQSVRTTLKTTRKNNNNTKLGNVSGLCNFSESQHRNLRNMSNPHVSSFNTTTYVRLLLYPPCKRDDG

SEQ ID NO: 26024 - protein, 64 aa, Candida albicans
YYYYSFLLSLTLCEHFDIDLQINFEGNSNCNELIVIILFLQSRNRSLLNNTKILGHRNMVEVKS

SEQ ID NO: 26025 - protein, 177 aa, Candida albicans
YYIINKEHITTSADYTKTQTKSMTASAHYNYNRRNSSATPYTIPTKHQPQHQHQSPMVSSYQVHHHQHSYNPQTRQHTSYQPSYSQESAISSPLLSASVPTLSREFVVRRISEGETGRLKEELRCEACGKGYKHISSLAKHLWEHTPEWHVTKKLLISKHQQVQLLAASSPRLRIRL

SEQ ID NO: 26026 - protein, 92 aa, Candida albicans
KSTETFVSKIHTDTLMNSGRNKQLNETKQIKKGGKGSGSLYTKFFKNTCMGMYNLDLNMNKIFLMVTIMVYCLFCKRSVSLKICWDMVCQIF

SEQ ID NO: 26027 - protein, 76 aa, Candida albicans
ISSVPSPHRINNWYYSSSILVYLHESFKMTALWVQRLKHAVLVNTRKLSLFPHENKKKTMLHQEITCELDSSTYSR

SEQ ID NO: 26028 - protein, 74 aa, Candida albicans
YSFCVIGWKKVSLITTNSQNTTIAMSSDSSSPETTTISEQNTTTNETGTGKQGRKKTKSSVLSDEQKKVCIQSS

SEQ ID NO: 26029 - protein, 86 aa, Candida albicans
AHHIASEQKRRENIRAEFDKIVSLTPNLNELENRSELNILTKSADYIDELRAENIKLIEICRQKGISIPPELIYSGPKNDGSDIAK

SEQ ID NO: 26030 - protein, 120 aa, Candida albicans
  UNSURE (10): Identity of amino acid sequences at the above locations are unknown.
TRNFITCGAXFVSTIIRNRGLMQTILLLVVVLEVKKQVLVPGNQTISTIMNQEHVGTIMNREYEMIIKIPTMSEESLNWLQDKNKDGGIFKIGLMQVEWILTFQKLPQQNFGNTVVQSLC

SEQ ID NO: 26031 - protein, 102 aa, Candida albicans
FKLIESKKVEAVKEDDLQEFGLENLDITVDNRKQVDYGLKNKFTVDKGIKESELCLLDVSTKMDPEEDELVRDIIDQVRNNPEDIREQLISAPAECHEIAAQ

SEQ ID NO: 26032 - protein, 60 aa, Candida albicans
WFIVTLVFGLYKGQRFPLSSYIFYIFIFFSLVSFHTTIRVRIKDIVFPFFILLSTSTAVP

SEQ ID NO: 26033 - protein, 135 aa, Candida albicans
HCYIKIQSTMSMPGSIDPPGQAQGQAPIIMNQESLRYLGAVIAESVTKSQDVVKPTNFKGGNRSGGEERGIDADGDTIMANLMQSKKLSWTERKFLKQNNACCTCYRVGYKSFDCPYRKDNKKNPPKQTNKSDLN

SEQ ID NO: 26034 - protein, 362 aa, Candida albicans
  UNSURE (10): Identity of amino acid sequences at the above locations are unknown.
DAEFHYLWGXVRLDNHSESRSNADHSTFGGGVGGKETSFSSGKSDYIDHYEPRARRDHYEPRIRNDNKDSNDVRGEFELATRQEQRRRDIQNRLDAGGMDTYIPKTTTAKLREHSGTESLLKKYDNYQPINISRGSKSPSPSKLLSISQSKADLISKPSAPKVASRESSLERKQVSNGIRTTTDVEPPRARARGPTDMFGRPLTSNSTQAQPTRNKSVERPKDLEKPTNGVTEDRNKKPVLEEKKEVVKPNLAIPKIKKSSSLVLLLSRSSTTPVISNPSKVTKRAASSVTPPVLPKKPKISKTSSESEVSDLEEDSDFTGENATVFERFMALEQLQKSPVYKRIINEKMRFEKLSGRHKSM

SEQ ID NO: 26035 - protein, 69 aa, Candida albicans
KNKIKRKSKFSLQGRITTRDKKRFELFDFRGDDGAKRSTTKEAHNFLNDSRKSSISDISSQKFSRESSP

SEQ ID NO: 26036 - protein, 72 aa, Candida albicans
  UNSURE (64): Identity of amino acid sequences at the above locations are unknown.
QDRKVTKTFPLEYNESTLVNGHVTRVASGIFKATGENGEEITKTIPIEYRKTTERIEFITVCPXYTSKRSSH

SEQ ID NO: 26037 - protein, 65 aa, Candida albicans
LQVYCWFDFSLYYCLEVVASEKVFKYCQTVFLFASISNVFSYAFSLKPQFYICGMFYQTLIEECG

SEQ ID NO: 26038 - protein, 73 aa, Candida albicans
FIAIMTSSPPEYAPTSTSSFTVSTSDVYNQEVTKSLLIKTPLHKSVYDSLAEIYPILPTLEMVENSYLKRLYP

SEQ ID NO: 26039 - protein, 138 aa, Candida albicans
VIPFATTSSFIYGILIYLLPLCKLPTTTTTPRFLTMDPNIDIDIFRDLDAPFMEIFHRKPLQRYLEHLPPGEREQQLNNIMAQGDLYLSQQQPQQQTPRYYHVHWIFSHIPFIILNFDQMCERFFMESILGTYNRCYN

SEQ ID NO: 26040 - protein, 239 aa, Candida albicans
ILIKCVRDFSWRAFWARTIDAITSAVIMTVRALRFTTFIIGSGVYFQGVVRRLFVFCDVITFSDNFIRDMFTYILRDSKDILDQCVLLERHLRNVFYFLQYDEYSNLSSFQVIKLAYQNLLASLINVECITYAPNSTGSTTTTTSSSSSATTTSCKILTNTLVFKLSSVFQEYFPALGSTGLKLITLWMYISYALIGDIICLNILLFVSYNLINRFMGYKQVFQGLRDILWNSLFKFIL

SEQ ID NO: 26041 - protein, 76 aa, Candida albicans
LYTRFKNNSWAKISILCLLKRLLIAARPDSNNFQRLSNKYRQCVAPMKVPMVLKKLLDLAQRFSFDNYTYEYISSH

SEQ ID NO: 26042 - protein, 60 aa, Candida albicans
TNFKIRKTTKNYPNFSFLLLIYKNIVVIVTNSWTYRDLIPSFQKETSALSFTINGFIYYC

SEQ ID NO: 26043 - protein, 68 aa, Candida albicans
FSFVRFFILCSPKLIETSDTFTRLSWVNFFVHEFKYHFTIHLLFLFFFSSVEITCYPLQLSIYVSIYN

SEQ ID NO: 26044 - protein, 62 aa, Candida albicans
KPVWVIIYCSYVLLRLSHTSSLTTKKNKTLPKLFTPFLNQLQLQRAISIYLEILVPSSVPRI

SEQ ID NO: 26045 - protein, 71 aa, Candida albicans
TGNTAYICNYLAYTSFYFSIHFNLILVQIYKRCDNQITTSSIMFTLIKQYSKLLTTYTKEGEKKKDIVYIT

SEQ ID NO: 26046 - protein, 61 aa, Candida albicans
KLFESGRAAIKSRLSKQSIEIFAQELFLNLVYNYTTKLEIGQLKQILYLPVNRVYVLVYVS

SEQ ID NO: 26047 - protein, 93 aa, Candida albicans
KKKKEKEQKLLANNNCVIFENCVLVGFNRILNKFVFTTTIYTYIYEEIHALVALQSIRLDVRYIKYNAVYLSIRKGHENIREKGAVKEILCVF

SEQ ID NO: 26048 - protein, 64 aa, Candida albicans
ISNYFLFLSFFFFSYCLFNWKIKSFLFLQQLESENKYIHSPRCLIRPTKLPASHCQQKHYIINE

SEQ ID NO: 26049 - protein, 146 aa, Candida albicans
SFTYLLSTVHFMFSRLVSYRYPIGVQLKQANRIMSNKKQQSLARFFGGITPPSGSNSTSPEKQQSLTRFFGSSSNNSSPKKATTEAKQKREATPPKSPPRSKKARIETKYDESSSSSSNGDIEMETEPILEKNNGSGNDVRNEEEK

SEQ ID NO: 26050 - protein, 103 aa, Candida albicans
TFYNTMPHFSMSGNHQLNKKSQVVSPTAMNGDAQAGTHVLSSWKRTCLSYQSIGTLTLLKEKVVERVIFFSPNSSEMGVCPYVQEFMSALLKHTQTLNLSYIP

SEQ ID NO: 26051 - protein, 477 aa, Candida albicans
IPVRKDTPPFQMSLGRKKSPFRQLFLSAMLKYQLIGKKGRFFSKKKVHEYPLVHLHSLPLEILLEIFCLVDDYQTLRSVALCCKKFNHIVNKHLLYNLIVFKNPKKFYQFATIHLLADISNKINFLNTIEFINPQIKDSENTKLNIAGSYAVESKVRAMDQLNYTEFILSLSNLFTHAFGLQCVIFSEISPSFGFPMESKSGSSNIFKRKAPKTKNRRLGKLVMKTQSGWSIPLRNTHLSLIAEYFDVIDELCLVNFIIDNPITIKDLRINKIHFESCIYPFKKGPKRENLIFTNVSELELSKIANSTELSLIDLIKVKNEALHYLTLDIGSNIFYTNQEFKFGKYNPFFQLLCSGVGGYSRLDTLKLTNFELFDYLRHDDVHKDVDSWIEPPTDNFETFMEYTSQIPHLIIVLRKFPPRVKTCLKCGFKEQQLDKNIESLTYDDWKIFLKPLELNPGNTLQIFRHDYRLLYTKSKY

SEQ ID NO: 26052 - protein, 86 aa, Candida albicans
ANRKVFYFFHSPMKFSNTQSTKLALYFDRVLKDITTFNGDSTPQLIAPGCTLGVTDRDSTVYLNSKGVRNIDDPVPFSHTTRQGTT

SEQ ID NO: 26053 - protein, 60 aa, Candida albicans
NFKFLSTTTNITKVKKKDNQFNNCKSEQSLHQLANQSEKWSGDISIFKYLRILVSTYSMS

SEQ ID NO: 26054 - protein, 89 aa, Candida albicans
YYVSDWNLTQIIDKRLKQFDAWDLLYRHPTRYCNESNGGDGGLLDKSPNSSIPGTLIIEIAFFEFLLLDEKRCTLYKSRQNFLIALNQA

SEQ ID NO: 26055 - protein, 60 aa, Candida albicans
LFCYVFFYSICLKGDNIFSHHYNLLKKIKINASYIKVTQEQLTIKHQATLYSKKKNWFTS

SEQ ID NO: 26056 - protein, 71 aa, Candida albicans
RAVYIFMFLACEHYINVVKIWRDIEEVSKIALIYYFNLVIEYVKYCRVQVRGLDMLTKMGNNLLFFCKDFA

SEQ ID NO: 26057 - protein, 79 aa, Candida albicans
RKISNFSLSLCSKGFTIIFFSFCCCCSQHHHPNLYTYIIYINSRVDGERRNSLLNNLNLPPSPSQKKKKLIKTNPLSIL

SEQ ID NO: 26058 - protein, 93 aa, Candida albicans
FELNQTRLYGLKEGKEEEIEVDNLHISYIRMKSPIEYIHRLIIVFFFFLIYLIRFLFWFENLFSSVTICGLSLFCFALFLLVFCYIDQSTTAF

SEQ ID NO: 26059 - protein, 62 aa, Candida albicans
EQQQQKLKKIIVNPLEQREREKFEIFLHSFFVTKDTHKPKLPFLPVPPPPITSNQQTNNTNF

SEQ ID NO: 26060 - protein, 143 aa, Candida albicans
SPYYFLELITLQSFHYSILSFNIPSFLPSFYPSSLSCFTLSTHLITLWLLLLYIMLQEKMTTREKDEFNIGLLQNSPESSTNMSPDVITTPISKWAAFKDSFKPPEQKPLASSSSSTSSLSASSPHHNDVANNYDIEKWLRPD

SEQ ID NO: 26061 - protein, 62 aa, Candida albicans
RIMSSNILRIYYATMENVSYTLFVLLLSLDNVIDIFFRKIIYFGYCYYLAGNLVCAATINDT

SEQ ID NO: 26062 - protein, 81 aa, Candida albicans
VTTIITINSTVATIITVITVRIRFINTIIIIIIINTVIFGFQQWRKGYTLVKHQRIKNVEKLVRLSSYKFLLTTEWQLMLV

SEQ ID NO: 26063 - protein, 112 aa, Candida albicans
YKVFFGISTVEDNYGFTTLAFVDINLPVVYTNFARKILERIPNIFDYMDDHLIHTENITQPCVISQHSHESIKPASAAIQTSISCYSNQHQLLFKPASIAIQSSTKTYMMIT

SEQ ID NO: 26064 - protein, 74 aa, Candida albicans
CLMASLFFFFFFFFNIWKTNANQFSAKIAVDLSRFHRVIVTMYACPTNIKELPAALTNSQYFSALDLKNAFYQI

SEQ ID NO: 26065 - protein, 73 aa, Candida albicans
FFNIFDSLMFYQCITFSPLLETKYNSINNNNDNDSIDKPNSNSNDSNNCSNSGINSNDCCYSIMFGCIMNICT

SEQ ID NO: 26066 - protein, 81 aa, Candida albicans
THMLVNLGIHTLFTLILAYYYYNTFRLIPHFIQVYYISSLYYISTVQCSLTLFITTYLSQHPPIMKDFIDQISIKLYHSFK

SEQ ID NO: 26067 - protein, 64 aa, Candida albicans
FSCYSVSFILLFYKSPPLSSITFTLQLGYNYRSLNISFLILLIPASLKNVSAPRSNSASVLPTV

SEQ ID NO: 26068 - protein, 73 aa, Candida albicans
VNVTGNLKSFRINFVEFDEIMEHKYQPIQNETILTSIGGNQLKKDDAKKLLVVTDAADSIGSGDVALLSGDNG

SEQ ID NO: 26069 - protein, 69 aa, Candida albicans
KKKLKENGDEIIFNQGKFNTNEITYFFFIYSKQQQQQQQQTFYSQIHLKPTKKRKEKKEISFFCVYYVK

SEQ ID NO: 26070 - protein, 103 aa, Candida albicans
HKRCIRSASQVENVKAPRIGYGAPKFVDQHFSFNLLHICIHRLKFNFLRTENLNFFLPRSGFGSAIPDHKTMVVIIRGFAKTPGLSNNNNRRLNKRLNIKEGR

SEQ ID NO: 26071 - protein, 60 aa, Candida albicans
FFFFFSLPQYYYHHQLSAIDTISWCNEHAQDLSMEKRQSIYSKGKNNIAKGRSKHCCVCI

SEQ ID NO: 26072 - protein, 68 aa, Candida albicans
RKRYNWFEYRIVNNQAIKKYKKIESSTSLKMVTNNITKLSFHNVFNLFFRNLALYAKSMHALMATIWD

SEQ ID NO: 26073 - protein, 60 aa, Candida albicans
SRHVSGLFIYRYQFINLSQVDKKAGLMDYIHSKSDRNLLWRDNLIHKTKRTVSVTLNSCS

SEQ ID NO: 26074 - protein, 68 aa, Candida albicans
RFVLLSKKMKSLFPLFIVVKKDRKPKNSQEKKELLSKIIRVSIKKYVFVLLYNKTNLFGKEDSFNVGA

SEQ ID NO: 26075 - protein, 66 aa, Candida albicans
RCVWCFSGARTIISWLVVVFALCYSKYCMRIVCSVSALGDLQDAKESSQLLGIIDGRFWRIGLTCS

SEQ ID NO: 26076 - protein, 68 aa, Candida albicans
SSCFWAKLNAPVGLEPNRNALLDEFDPKLKLGVVAESPWLFEAPKVNGFALDDPNTNFGASDLSSRVF

SEQ ID NO: 26077 - protein, 111 aa, Candida albicans
GGSLPVVKTNNNNNNNNNNNNQLDKNEMDKQQIDLLLPSTPSNNNSKKYQNITSSQQLLSYENNHNHSNLIDFDNNNTKNDEELVAVDRLACSILSLVGKNTNNQNIEWNI

SEQ ID NO: 26078 - protein, 109 aa, Candida albicans
IIIERCFLLYIKQFIYLFIYLFIYLFIYLLAHIIACNDVNYHPINYKLLLGCSQFFFTNYIKKPNLIQKKNRINGPRPKAKAKAKAKAKAKAKAKAKAKAKYSIQCFDY

SEQ ID NO: 26079 - protein, 68 aa, Candida albicans
MRTVKMGLKRWKNFVEFVRTEKKTNPINFTVDDFAGKIRCTNYHSKVVFSVQQEAVITIDYFGYTEYF

SEQ ID NO: 26080 - protein, 70 aa, Candida albicans
VTEVLLETVMISKSFNFVEFGFDTSINEGLNGCNYSQILLTDVCSQDNKEKSLSTTINERDRKKKVCNDY

SEQ ID NO: 26081 - protein, 61 aa, Candida albicans
LHPFNPSFIEVSNPNSTKLKLFDIMTVSNNTSVTYPIQQQATIIAGFGIHQRNGSTELAKK

SEQ ID NO: 26082 - protein, 88 aa, Candida albicans
TMVFTLPDRIRTLKLRELKICIYIYISYVSNYKVNLEIEPTVVVVLFSFYSHSGIKKNAYTLALISAVSSSSSNIGFQVTISIFSVLN

SEQ ID NO: 26083 - protein, 118 aa, Candida albicans
ATSLRNGNNSFLVRSGPKAIAMVSNFCIASTLLETSSCFNSSINKANGYKSSLKLFIMPVLLLKFLLFYGENRLIMPDNQKKIGKLNTSNWKKIKKKKYKCLDKYNWEGKTKNNQLII

SEQ ID NO: 26084 - protein, 81 aa, Candida albicans
RKRKKKKKEFVAFWEKFDQTYFDFQQQSPTTITTTICSFNNQYFTNFYFTPHTQQQFILLIDYFLFSLPSCIYLNICIFSF

SEQ ID NO: 26085 - protein, 83 aa, Candida albicans
GLLNSFNWLDQKLISNSFDRQNSPLYIEGPITRFFFLGKFQFIGVYDTRHHQQIVLSKLHTKVREANYTLLNYSSIKEQTLHT

SEQ ID NO: 26086 - protein, 441 aa, Candida albicans
LQMFSPFYNGDYSYDQPIDFESLFDLLHQHQFYYKENTRPRVIKKLETEDEFQIQIYKPYGNYNNYEVNVVKSNPPIVNVVISSVQDNFKTVLPFNVNYIDIDNINWQWYKQQNVLVLNIPKRIHYVHLNVQDILNCLLGCNDADASSALKAPNQQPYAKPQTKKDVQAKTSPKKKEEFAKVKKEIANNNNNNLASRDANLKDSIEEHENLIEQAANALKQATENSSKQVKQDLNGKANALSAGAQAAAEAKHKEALEKTKQELEAQRKAAHDKIVKAQQELEEIARKEAEAVKLHEAAKQKELEEEKRKVEAEQQKAKEKEDLEQKEYDQFVKQQQEFLKQFFGFNLGPAIPTKDGANAFYTAAKQAKKQKPKVAPKPKQLQTQPVKQAKDEEESIPSEPETEEPESSKSHNSNENLHKHPSLEEVEDEESVMFRKRFGH

SEQ ID NO: 26087 - protein, 80 aa, Candida albicans
LFNDSWTGVFFIVELMLMQQIEKRLEIDWLVVGIITVVEWRKHLQLDSLIIYDILLMNKKKEKFREDDILRIFLAIYREK

SEQ ID NO: 26088 - protein, 82 aa, Candida albicans
WLRIKNNHRNQNIELNQLILHRFDIIIESSVLVAHIRNRKQQRETRENRCRGVRRYQVNDADLITRARHGLELHLIRIVREK

SEQ ID NO: 26089 - protein, 74 aa, Candida albicans
LLWSIGFIKVVVYNRSNLSLFREPSMKRWWKNFQQKADHPPFQYNFNQYTQMAPKVREDLVIPYEIESLLLRFA

SEQ ID NO: 26090 - protein, 76 aa, Candida albicans
FQLICNYINLINEIPFELKLAHNVERKNIAKNFESTTNSRNKNERVHLQSKQFGSVGTSFNSFRKLYVTVIKIQTN

SEQ ID NO: 26091 - protein, 85 aa, Candida albicans
SGIGKRVSGPLERKFTKQLNEGVKTRKFSLTKAFYCSILKCNQVINMCKGYFLQCYFVFLNRQNSINIAQSSPIDKKKKKKNCYY

SEQ ID NO: 26092 - protein, 186 aa, Candida albicans
TFVISNWGSPFPVLPHELLTLESFVFPAPVYVRCQVTINPKPKYSYAFLNDIAFFVPCQIPDFLIVDTTDNINANTGTTFGPEYLGDSDLFDCDGNLLNGDSFSEYELDDDAESLVENSSLVEVYSDLDNGSDVRNVRRNTGTVAEIRGLGLTCIGDSLLGPFRIVGFLPVNIGTIFATGSSHRFG

SEQ ID NO: 26093 - protein, 64 aa, Candida albicans
NMRVYESICISMFVRFPKFCFSSSSAFERKKRQREEKKFVKEYLSSSQQQQRYTIQHYFENLPS

SEQ ID NO: 26094 - protein, 74 aa, Candida albicans
ILLFVSSKWKSNFCCNSSKISSSSTEVEEVKSKLESFEDMGEALIGISLVKNSRVVFEKSEGTNCSCKTLNNLS

SEQ ID NO: 26095 - protein, 60 aa, Candida albicans
  UNSURE (42): Identity of amino acid sequences at the above locations are unknown.
KRVFKVEHQDIKKLRKKEEYINLNIIFLFSVGGINCCIYMRXSTWRVKLSCNNNIYLYQM

SEQ ID NO: 26096 - protein, 106 aa, Candida albicans
ISRIPFKLHNIMKNPFDSGSDDEDPFLSNPQSAPSMPYAAYTSDRTSPRKTYQPLNFDSEDEDAKESEFMAFPLSTSGSPFHPNSNPQDNHLIFFPEVLQEQQPQS

SEQ ID NO: 26097 - protein, 87 aa, Candida albicans
VFRISNIVVTLSINQTGQNLKMDLGGGNIYSALRINKLFSFFLFQNLAVPWNYIKPCFKLISSLIGLQGKRWFTRLTILLTFLLLRL

SEQ ID NO: 26098 - protein, 85 aa, Candida albicans
PPYVFFARRGRYLIVKDQKIDLQKEAFSLLMKSALKQVDKNYQLKIEMNKLRKELVDAQARLVEFKDEWCIFGPELKKIRRQKKV

SEQ ID NO: 26099 - protein, 80 aa, Candida albicans
INGTLLVKRLGESIDNINQLTLTIETPFNLANFQLEEIQSIIRTYFYDIDSINDINRNINIEVIKYHSLKESVQSGAPRY

SEQ ID NO: 26100 - protein, 60 aa, Candida albicans
EVRHYYMTSPGLQIIKKDNQQNDTFFFHSIAWKLNLFDKSATRYFDWSLVNHWWELQLLK

SEQ ID NO: 26101 - protein, 98 aa, Candida albicans
FNKRVRSVILIGSLHRVKKKSLENQSYSYFEDRVLERKGLIKLIIDCMLNISQTNTDSTATNEYLIAHIMTPVGSRQIQADRVSHLLTSARAFSSGYK

SEQ ID NO: 26102 - protein, 60 aa, Candida albicans
RRILYEQLISFIILNSIQKNYKSFFWLTTLQSPELVLFSKLIDYKKKAKRDRETTTRQIG

SEQ ID NO: 26103 - protein, 70 aa, Candida albicans
CLTISFYNRFIETVVSLNEQLAISNLTTYIVCVFYSTKYSTDIVINFTKLKAWKVFICRDKVLDEKLVKN

SEQ ID NO: 26104 - protein, 89 aa, Candida albicans
PIQNFTNFLTIKKLRLIVHLHENNQTVMYKKILILNIIVYRKEKYPFELRDIFHPIILVVRKPAALQIRLLSALGGFTAFELDQNYHHN

SEQ ID NO: 26105 - protein, 61 aa, Candida albicans
FKRLVNHQCSPVSVLRLHTLDFVLNKKIASNLVKWNSCAGFKKKIAPLRKKCVYAELQLVT

SEQ ID NO: 26106 - protein, 79 aa, Candida albicans
NQFLTVERPFLKIIFTCISLTFMLNDVYIKRKSLSISHHMENLLTGKTYNKKSKRFKEDSKKDMHSIISLCVGCGVDQM

SEQ ID NO: 26107 - protein, 92 aa, Candida albicans
DHFELSTNYCEKSRLRSIVCRIIPCGAQTIRLFVSFNTTYIANHIHEKEKLTHQLVGGLRDPMKQSQQYSKSNQRVLENNNTPQTKKEEFIT

SEQ ID NO: 26108 - protein, 63 aa, Candida albicans
ERIVCEETTHSRAKHFIRAVALNYFSACASYEVEEEERKKKKFQNIINKQNFQFSLSLSLWFF

SEQ ID NO: 26109 - protein, 60 aa, Candida albicans
MNLANVSCIGSSLINYRLNLSYKYIYISESLSAEKLFNDLPTIINYNIIFNNGITPLPLL

SEQ ID NO: 26110 - protein, 137 aa, Candida albicans
DEANDKSKEFLKEARKELNHLEEEGQNLLSQFVAYVKSTANSIGQSLNKAGAELQLATSAAVSRTSVELQNPVVIAQIAVAAGGAAAGYLAYLERYRINTDNKYVVGIHASIITGLVVLDGYLFSTYYPKYDKKVAK

SEQ ID NO: 26111 - protein, 83 aa, Candida albicans
NIFDWLDLQYSKTAITKLSNCKKSYNKIMHKVCSSWPPLLHKKYQTLNCLNSSLTFVTQISLYIDRKRTSSSFMLSPFIHARN

SEQ ID NO: 26112 - protein, 62 aa, Candida albicans
PERFAILIYVSLFVHHTKAKPINEMRSRKTAHIWSTPQPTHKLIIECMSFFESSLNRFDFLL

SEQ ID NO: 26113 - protein, 103 aa, Candida albicans
  UNSURE (99): Identity of amino acid sequences at the above locations are unknown.
TCVFQNCFNLAFPSLTSYNVKEILNSHYLFIDLFIISLIMSSQAPSDEQIKKDVKKDADNIVKKGKEESEHLKKQGKEAVDEAREKVKEFIDQANKKGXELLG

SEQ ID NO: 26114 - protein, 73 aa, Candida albicans
YRRGTFQPPWLNTQAYQLINEVADDQLNDYLDCFIKSGRIKEFMAKCGELSIISCEQGITGIFSGTTKTTDSI

SEQ ID NO: 26115 - protein, 68 aa, Candida albicans
IPGNQDLSKRNITAFVLNDRYSLLLDKIIFFCMKFTKIEFKSGDKGFLCVLEETDSLPYIDAIISLLL

SEQ ID NO: 26116 - protein, 101 aa, Candida albicans
RLQQLCCQKKNSSFSLVLLHLMLKMPSQAYNYNINKYSVYKSDTNSWYHYPQRTNLSVTFVYNGDQADQIDVIVHWKGSNLVRILFLVYSFQLFICACLLY

SEQ ID NO: 26117 - protein, 238 aa, Candida albicans
LSRQSNKDNFNLFNTNKCKTTVLCRKPCIGVKQVNNNGIVFKRFQVSLINEVTSNFDTCCTMLRGFNFQIKIKDNMNETEAQSQQNNGNIQSNDSQIVQPIQSISDTQMYPLIQPASQIPIQLPSQNMASCFSSFSTQPLQPPSQIIEPQIYQLFSQPGHVMHQGKIPETTNKVVSTNLTIDATTQTLPRKLQSVFLDDINELKKISNSSLRSVTKTLLQRKDFLDLIDRLDKIITDI

SEQ ID NO: 26118 - protein, 112 aa, Candida albicans
YKKKRKQRYLGYRDRVSVDTFSGRKLYLLCFLLIKSQCLSCTRTNSVVEYKVIYQKWLIGYFVHDKREIYIYVNLLAKSENCNLVLIIVEIQYGFSEMNYARCTIGTHTHIS

SEQ ID NO: 26119 - protein, 541 aa, Candida albicans
PRILVLLEGFQFQPFASTSQSKTSVSSVVSKSTSEDDDDETECETDIPTIIPSGSVLPTTSVLPTIIPTGSGSITILPTKSATSDDDDDETDCETDIPTIVPTESATIIPTGSGSVTIIPTGSGSITVLPTKSATSDDDDDETDCETDIPTIIPTGTATIKPTGSGSITVLPTKSTTTDDDDDETDCETEIPTIHPTVSTSRTFTSDGVPTTQTLTTKLPPTTSQHTETEVVSITYTGGGQTFTTYLTQSGEICDETVTLTITTTCPLTTVAPGGQIYTTTVTVITTHTVYPDDWEDDGYEGEDNAGGSASGSSDDGEWEWYEEDDGECVPTGGSSSGSGTGSWWGSGAGSSGGTTSGSGSGSSSNSGASSGGTWGGSGNDYVCPGAEGYDDEEPDNGGSWWGGSGSGSSSGSSSGVSSGDSGSSSVTGGSSGSWWGGSGNDYVCPGEDGYDDEDDQTPEPECDDEDDSWDDDEECDTQAAKEVVNSVTVAAESVYPSTTAASLTTSWISTQTAQSVTQIENIGGKVSASGLFVVLGLLLI

SEQ ID NO: 26120 - protein, 67 aa, Candida albicans
YKGIVTGYIIAGSFDPQTWNCLEKKKIIFAYFVNVRFIIFQPSSLVRYIFSLIPKIFKNRGNCRNNF

SEQ ID NO: 26121 - protein, 81 aa, Candida albicans
SFPDPPQVPPELAPEFELDPEPEPEVVPPLDPAPEPHQEPVPDPELDPPVGTHSPSSSSYHSHSPSSEEPLAEPPALSSPS

SEQ ID NO: 26122 - protein, 264 aa, Candida albicans
  UNSURE (42): Identity of amino acid sequences at the above locations are unknown.
TNKNNFITPLFPPTMPENLQTRIHNSLDEILKSSGYIFEVIXQNRKQSHVITSPNNELIQKSITQLLNGEIQNFHAILDQTVSKLNDAEWCLGVMVEKKKKFDELKVKEEEARKKREEEAKKKEEEAKKKEEEAKKKAEEAKKKAEEAKKVEEAAKKAEEAKKAEEEARKKAETVPQKFDNFDDFIGFDINDNTNDEDMLSNMDYEDLKLDDKVPATTDNNLDMNNILENDELILDGLNMTLLDNGDHVNEEFDVDSFLNQFGN

SEQ ID NO: 26123 - protein, 61 aa, Candida albicans
PCRNCLLLLTAEEKKKLLDVKGFQNSMLHRLNIFILPSTPFNSQGIIIALDDLTPKHSWCA

SEQ ID NO: 26124 - protein, 61 aa, Candida albicans
EDPISRKRNHQKMKSRKKVKMKRCSLILILIQKMKEIIKLSFPLLLFVHSFIRNCKVLISL

SEQ ID NO: 26125 - protein, 88 aa, Candida albicans
VINIYLPKRKQTTIDTHTKLHQEASPKKKTTIAQKKKVYNLTLPRAIATKQQETVLQYYNKNRLITQFIYFLMASKLYIFLLFLPSSL

SEQ ID NO: 26126 - protein, 74 aa, Candida albicans
NILRVISCTITNMVTGGITWINDDVVLSIECKTNEFLHVITAHDNVPNDKENTETNKVGDSGNTQMNNISNKLT

SEQ ID NO: 26127 - protein, 311 aa, Candida albicans
  UNSURE (57): Identity of amino acid sequences at the above locations are unknown.
GVHHIVHQQVMWRQQQQQPHSQQLQPGPPPIAPQVLSHNDYLPHNSFGHQEQPYISXDQINAAHNLDLNSGNTLMPIDTSISTNNLASTHLNGFPYDDNIYTRGINSPLPLHNNAALNYGDYNSLLYRYSSPSLTQSNSNLADGVWGTTTNNGNNLSANDLLNPTQQSGFLISPSQSTNIWLDDKSQNLLLNPTNGTHTRAVSSNSQIWRNDATSLNGGGGSNPIRGFDFGGVSTQGNGDFSPFGNNISIHNPTDSLYGVNLSNTQVNDQQLQSQPQSHLQQQQPHPNLTSFKSDNDENDSVMGGKEQFFK

SEQ ID NO: 26128 - protein, 76 aa, Candida albicans
VNRTDSLVSMQDLLVSMQDLLERSLDSLVSMQDLLERSLDSLVSMQDSLERSLDSLVSNLDSLVNNHILVKCTLEM

SEQ ID NO: 26129 - protein, 84 aa, Candida albicans
KYYRNLSFVIFRDFPRLLHFKLFLLHISINYRTILFNFQNGIIKKKKKLIPTQNALRNALHKAVSFHFVSFNRDWIYFKMSRAF

SEQ ID NO: 26130 - protein, 68 aa, Candida albicans
FLLFCGGSHYRCKCHFSEVDSPDKEENQLGSYYEFIWGIRRVLSSDLVAFDSYHFSCLSFLKTSYLNI

SEQ ID NO: 26131 - protein, 106 aa, Candida albicans
IRLNIIKSLIDGRNNEKEKNYPRKNHQEKIFFFLGDGDQKAGRQAGRRRSWSCHLSGGFMFKLCVANSTRYLHAASAESLYNNNKKKKKYLMPNYYVGLKLVFMYS

SEQ ID NO: 26132 - protein, 63 aa, Candida albicans
GNFHYHCHHYYYYNLYTLYYPIGLDLNGSLIFSSCRRRDLFYYFLSLFKKLYLELNDVYCHKI

SEQ ID NO: 26133 - protein, 68 aa, Candida albicans
KHTPICKMYMGCLAVEPLQFPSSPPDCQMPNIVLGVWWGNNEKIYRLWIEFMKPSRMSFFLQFLLQGV

SEQ ID NO: 26134 - protein, 64 aa, Candida albicans
ELDTFNQEESYQHPATEIRPLNTNFSIKRQSKYSSSLSLRKISKKSGNCQKLPSQSLRLFGSPK

SEQ ID NO: 26135 - protein, 64 aa, Candida albicans
LYENWKQKKGFTPINTQKMVEKSCTSISSLRNHRNHTTSTQEKPNRFSLKNQAKKLYVCRKFPQ

SEQ ID NO: 26136 - protein, 73 aa, Candida albicans
RDSVMVNNWWKSRAQLMLNHFMGKYHKSHKIITMNILQCPYVTNIDIVVVLNRSLAVFNTRAFDFVCADGLIF

SEQ ID NO: 26137 - protein, 60 aa, Candida albicans
DLNKLLYSVYFTILILLDKDQDKVERKKERQNHHIINNLFAVSCISYVCVIFYIEIIVRW

SEQ ID NO: 26138 - protein, 60 aa, Candida albicans
FLILFENGLLSTRYSTTGNRLTSLRRADGSSISTFHTEPSLDGCIVVTTTLTVKSKRLPG

SEQ ID NO: 26139 - protein, 95 aa, Candida albicans
HYHKNLKFKKHSFFYFFHLRFNFNFCLVSKSNKEHKIISFFLQLFCYSFIFQIDNSFHLLALISFLQEIKRKKYNSIDKLQPHNVFTTGKKIRVP

SEQ ID NO: 26140 - protein, 301 aa, Candida albicans
GACFLPAALVKNITSLAIPALSDCIVEGNSNDPVTSSIISNISNFPILYEFIFENVFTIKKTLFEFINENVLAASRISATGIFHNVLLSMLNITENVVFAIIASFYGISKNFPIISHVHHNFLEVVSKLSSTFLLICYLSKDKLELFLEIPHICFSLILNFPIFCFSFLQNFFDTHVASAADIDFQSSLSNAFLFGIKSGFTTRSCFFFWEEVGSVDRTVHKALETAHAKVTSTDDTSRKDLDTKLNIRVPVICQYPHVPDVVLKSLRSYLTSKFIGHYEVFKECLPSSMPFMEYTHWCCF

SEQ ID NO: 26141 - protein, 77 aa, Candida albicans
IFRVLLRVEVIFFLTGCKLQTAREVYNKKRNEAQGGAVNVIIKRQYKAKKLFASLNNRRVKIKKKKKKNFYACTYPH

SEQ ID NO: 26142 - protein, 67 aa, Candida albicans; identical to SEQ ID NO: 21026

SEQ ID NO: 26143 - protein, 104 aa, Candida albicans
LSRQATTLYEMWDDFKGLEKALEDYGISVTEWLKLHGSSERQFRHTRMKIIRFIEDVAARRNTNVEDIKQRLHNKMRNRIRPWTLDEVQRMLTANKRINLDDNS

SEQ ID NO: 26144 - protein, 693 aa, Candida albicans
LNMTIMATTTALSLPSSDVKTFHNYQVFLPTQLPIKRLYNPLKEQLIQLIKLPNDFNFKKKNNNANNANNEILVKVKMCGINYLSDFKSSAVNNGVIHKLRKPIVPGMRIICKIDSIKNIKFLVFPFTTCQLENIHNHPHLVRQQPLANKLEDSNNNNANSSVDHNCDLIYGKDIDGGLQTHLSVPKSLLIPIPYNISLHDVCFIFDILLPFYKFFQFVKPGKTIILLNDIKKELNEVLLILKIFNINFNSIIIIDGNSLSPRFNNKFETVYCFNRNLKYEAINYCVSTGLQATRSKYTVLTSFPVNVNSMLANPKTHKRHNASTDSSISSISTLASNSSFKSASMMMGGVNSGTSNNNPNTISNNKFKNDKTIKYMQLSYQDKPLCIEVLKILSAINFEREDQEKQKTDQQQQQQQDKQQQDSPELAHDGIIDDYDYNYVDEYDENINEEKYRQLLINDNDSLVHSTSSTHTGSSTLQMHSQTESDPHGNIKNHAKKNEKKGKRRKVITRKYHHYSWIWCNKDVYLKNYYDLNDYDVNDLTNDIDNIDNENEYEYNYDEYGYSSSYHYRDGYDDDEYGIGDNHQNKIIKQMNRLLQDDVNLNRVCYFNSDDHDNDNDYKDDNDGYEDPEDVNGDDNHLYEYKKNTSTSHEDNNESNNYEDENSNQSSSSSGNRTYKSHRDRSWAKNINACII

SEQ ID NO: 26145 - protein, 206 aa, Candida albicans
PITTTIIIIYILRSCYCCTTIIFKMSGNDSPIPGNATVKIEQLKSFTSLQSQVTSPQKTMNETNTHFRYLLQNTNNETILEVNADEGPSCIGPLSGKFRYIAAQPEVDDKNWSLPLGRVPPNQSVDAEVDMNDDDASYEFVDGENNADIQTALNTFWQAYNNKSSKLSNDEKLEMAKEVCNTLYDMADRWNGNTSKKQRRHRYSPK

SEQ ID NO: 26146 - protein, 61 aa, Candida albicans
LSALNVKDICNVITRFQRSSCDLSLSNTLLYSNCCIDACTSTIQYINATYCYVRTYLLVNN

SEQ ID NO: 26147 - protein, 72 aa, Candida albicans
RSLAFNHFTQCYYILKGSVKYRKAMRNSYIISHNEYPAKYSFLTACLNSMDPVKNIGKVNKLEIWLYTMNQV

SEQ ID NO: 26148 - protein, 68 aa, Candida albicans
VWCYQRTAYYLAAVAFAGIVAAAVVVVAAVVDCNDEVELHYLSLLTKKTVVGFEEVAWHKAFVEAGFG

SEQ ID NO: 26149 - protein, 94 aa, Candida albicans
KIQIYNKFTRVSRSINKYRVRKLMSEISIIGIVRIEIATIMMIVLVVMETKMYYYCVTRLVPGPPTNQRARVVHGVTRSIFQLLVSLFVFFYFH

SEQ ID NO: 26150 - protein, 99 aa, Candida albicans
CLTRRSRIVKHVTNGLLFTTITQTTLKIFLGSKKEKRYAYISYKLRRKLLVFISASASSPHKKNSLENKNGFVFTFQLSIIFLQEYKYKAILTGYCNPF

SEQ ID NO: 26151 - protein, 69 aa, Candida albicans
FNLPVALELVDLGNEGKGLEAPVYNTTFLSEYLNAISAEVSTPVLPPPITAILLAALISSPSSKIAFIV

SEQ ID NO: 26152 - protein, 63 aa, Candida albicans
IHQKKKHKEMFLLAELFLVKIKRQFCLKEMYGDEIFKNKYEATSYVALPYSLEVEAKRTGGNF

SEQ ID NO: 26153 - protein, 77 aa, Candida albicans
KFAVAVFLTDSPTDNSQLDFINCQVNHRCQLEAPYTYTKKQFNLHFNQLISLRLLRLKKAILGELATKLDINNIVEL

SEQ ID NO: 26154 - protein, 65 aa, Candida albicans
PHRLRENSDKTWEEVEVVEEEQRFSKQHKKVYAATPKTINEHKTKNRTQIEVRSFLQPRAGRTRA

SEQ ID NO: 26155 - protein, 442 aa, Candida albicans
VLLHCKGTIIIHLLPMRLFNSIILLAGIQIPLVLAKLVQNVETFDLNENSPIKCFNLDLIHGKTQLKVEANGVPHQQLPLNVHRNTKLLHMDKDKGDDDFQVELQSFNIYETLVDGFEKEELHLYEPGQYCVLFNENKEYIATFHSKVTLVENIDVIDISNEAYKHAISAIIGGLIIAGIVAKYQITGLSNISPISARIFSLLVVYFGFNSVMMILEWYCYYSPSSFSYLFVENYFKNIVGSIITCWDTYVTIMVYFGSGFKNLGYKAPSNISWVKRIILGSLLFVSVASSSKITKTVLKRSIIVDDKLQDVFTYFDPKDSFLKNSFISAVFNSITVILGAGLLVCVTVLPFVYGYVIYNRFTRTGEHVNQQLMKKTLLYHGIYAWIIGSALYYYFDAMKLVEDYVPLVILWLIWYSERPYVALKGLEDDLGHLKGIKEFYL

SEQ ID NO: 26156 - protein, 98 aa, Candida albicans
SDIEGRIKRVLYRIVVAFFVTLPYTLCDGYVTLKIACICSSVVYRKLLFRNISIFLVYFTRLFTIYREAYSRILLCSFIYIFNQSLTIIHHFIIKVYI

SEQ ID NO: 26157 - protein, 60 aa, Candida albicans
HSFQKMKRNKKKNNKQHSTTQHSHSHSMKCTPQLLLTPITYSSSCLFHCIVLYTRNQINV

SEQ ID NO: 26158 - protein, 64 aa, Candida albicans
HNLNLILDYFFFFFTLQRNTYYTHTYENPPLTNKTPLYPSNVLNHLQDPLMQRMVSQSTRSAIK

SEQ ID NO: 26159 - protein, 77 aa, Candida albicans
HEVYPTVATNTYHLFFKLFVSLHRAIYSESNKCLKKSHSKVIFKVKNLYEFGMFTKAYTLQPLTVTVSDLKYRTTSY

SEQ ID NO: 26160 - protein, 214 aa, Candida albicans
RLDPLFKLSLTEYFSLFDDNRLYKRTITYYPLTIPKKRKLSPESPQDYFEEKVFDVKDVKFELIYKNIYEFNEYLTKIKKSLAHKLLYTKLAGKSSAIIDTIFNNEIKKRKYLINKRKEIQMVNLLAVRKRSSRLEAKKQRQEELDRQREEESKYAAERRFERRMKLKNTENIDTGKLSRDQRMKLRQLNNESTPETETNPTPEPEQPEVIVLD

SEQ ID NO: 26161 - protein, 86 aa, Candida albicans
IMSQPQKQKLIPHQNQNNQKLSFSIKFIFYLCQISHHFFFFLPRHLQMSLATPLYYMVSFTSKLNSDITSDEYTQVADLMVSLAKQ

SEQ ID NO: 26162 - protein, 299 aa, Candida albicans
LRITNPGAKLLPFIINKKRVSMLRSQLPCIQKRTLFQKYSNPPRLSYVANKSYISLIWNNLIPQPLKLTCLVASGIVTFVNVHPRYYITLGPPVGLLGFFGYQKYRHWQYHKAVSKLDVTKWQDNEIIRIAKYDEKSLDNVIMGIDNQYDSLRRQIIQLLEQRIIEYILEHGVEDEITRSFISDDNQFNVHLPELEIESWVTTNVKLEKNNDTVSDFIMLSVPYYDSKNVHTRKRLGVVLIYLLQIPQQEYSSFIDYKIGIEVTRLRWINPQSLFFTKLESKALMQSDIYKSLNKENQN

SEQ ID NO: 26163 - protein, 99 aa, Candida albicans
LDSKFTIIVIILRTILKPSQPLARNQVVPKLSELPHGELDSVLQQLVIKIGTAPYTCQSTETYLAAIFYASLFLESSVHCEIYIPLCKNQNVLSMDVFF

SEQ ID NO: 26164 - protein, 73 aa, Candida albicans
VKVVLQVGVMICEQNSGESNGLKLSFGKTADTGDTATVVFMINCTISSENNLKIFIMENSDLEWVFLLLCCKF

SEQ ID NO: 26165 - protein, 64 aa, Candida albicans
SVLLSNNVSTKIKFDKRFCRHLYRWIELNANSGIKIKVKNNFRKKKKTEDIRKRNEQKKKNFKL

SEQ ID NO: 26166 - protein, 90 aa, Candida albicans
LGQKNQIRNNDNNAGPYESAKYPSTGKQKYIPNADNDEIMLICKYDSPNTSWNDDVYNVNNNIDPATRQDKREIKNATTLRFSKAIRVDK

SEQ ID NO: 26167 - protein, 121 aa, Candida albicans
KKKQILQQQSLPIMASDWAAKLSGASASPERKPRKKDTEFNSREVMDYLHNNYNTYLTHAREDKEGEKYKVYKSLESPNQWTSKPKNGPKEVIRNRNGSNGTLDLLFEINRSVYQQRERNK

SEQ ID NO: 26168 - protein, 85 aa, Candida albicans
IQSRENMFRAIALIYVSLYKFLVCLFLLVSNNAHHFLQVIECMYIFSASMRKRETDILLKGKKFELSAHTSSPGGWTVIRFHPLE

SEQ ID NO: 26169 - protein, 68 aa, Candida albicans
CALLLTSKKRHTKNLYKDTYIRAIALNIFSRDCIHQSLYKFTFCGLLECCKKISTGNSHRYDSGEINN

SEQ ID NO: 26170 - protein, 79 aa, Candida albicans
TPINRTTKFMSQNIPNQLNLRYSRNPTLAFLIEYPPSNPDWEVLTLWDPLLRLELKFTNELANPYGTFWQKKSSRLGFL

SEQ ID NO: 26171 - protein, 81 aa, Candida albicans
INVFQFITYYIFIVYFLKIATTNSRLSCPTNKQLKEGKLFCKKCLLLFPLYCINHSCSTKKSTNSYCSEPLLLALIVTRNF

SEQ ID NO: 26172 - protein, 66 aa, Candida albicans
SRQTCNQCTKELTKDLILSSLVIKYIAFAYNDKRKYLKNCKKLQKLHYFSVNTKYVYHIAFSKLYK

SEQ ID NO: 26173 - protein, 213 aa, Candida albicans
INQENRKNRKAMDYSGITRGSIRAEALKKLAELTVQNPSSNLKEVNTGIQKDDFSKLLSATPKLLNSRGKLNGSVSNGGGAGGSSGVRDRLSEVAIAKKEYEVIIALSDATKEPMKVDSQIQTLINKFKAYLFELPDQKFAYSIVSNSATISPWNLLGEKLTTGLINLAMHNIQQYVHEVVDIFQEFIERFFDYMNLHLTHFLILARVWDELY

SEQ ID NO: 26174 - protein, 63 aa, Candida albicans
WFCSCCSSLKCHIQSIFNMYICICNQEHTFYLLNKKQKKTYSNFKSENFFVRVRMFLSHNGIV

SEQ ID NO: 26175 - protein, 71 aa, Candida albicans
RIATISKAFSTETCATLLLDIDWFMIAVLYLCQRVIVNLFLSLKLQNINTLVKCRHNILMTIIRTAKVYKN

SEQ ID NO: 26176 - protein, 65 aa, Candida albicans
VCVYGCVVGMVLIKVDIIDLYVFNILQNQLIIFLLFLVLPNVVALIGRNLIGLEKQLVTCSARFR

SEQ ID NO: 26177 - protein, 65 aa, Candida albicans
LSSGPYFKKNENPITFTEINRVTKKKLDSYFIMFSSEYLLKLGLLIRCKSIPVHHFFTADRPDQQ

SEQ ID NO: 26178 - protein, 146 aa, Candida albicans
  UNSURE (127): Identity of amino acid sequences at the above locations are unknown.
FSTTLNVAHSTTSLPNLDAANPSSILPQSALNQSEYYKVTNGSMCNDPQPSTFLYNLHNHSADLVMNNDLEFSNASFDSIGGVSVSAAATGAGAGAGDYSHTNITSNFAQTNLHSSSQQSGVLPPPXFSSTTTNIFTITTISESIS

SEQ ID NO: 26179 - protein, 89 aa, Candida albicans
FENLLKLIKIDFNIIISWIVINQINCFFLKKSINTINLPIIPYNQENKNQKTINKWVQFDIHIYHIYIAYKLLITHNFRVLISFHQNNK

SEQ ID NO: 26180 - protein, 89 aa, Candida albicans
IQKRKGIDLLRYNNIHSKVPTIFHYYLLILNNLVGLSLLLLLLFGFFYFLIRRFYLFEKNIIYFFEKYRISRELFIIDINNSINLHFEK

SEQ ID NO: 26181 - protein, 82 aa, Candida albicans
SSTPLFIISSNQFIKLGDREVRQYYIEIKAKPEKTKYKFSEINGLRNLFFFFFAFGVPQIYPSSLVSLPHFFLTVNGYPSFS

SEQ ID NO: 26182 - protein, 222 aa, Candida albicans
MITHMVTPDSTSSAPNSPYGEDTIKLNSSVISSSSPVRSTSYLQNLQLQQQFLQLQFLQLQQQQQQQDQQLALQQQQQQQQQQLQLQQAQPYANPYFQTPIDQLFQFDNNPNSSFNPTRPPNIHTNQPYVSPYLHLAPLTNHSDLQPQPPPALLLDLELGLGLVKQQQDSLPPQQQAQSQPTPLLNQQHPFYNEYINDMPSTQHPYLIFNNTKCCSFNYIIT

SEQ ID NO: 26183 - protein, 309 aa, Candida albicans
KCKLAIDVLAGSVTKTMCFIRKTRKINKQNRARLQKFFFFINTCQLLSLQLHTQLQYEMGRDLIKIEDFPEIMDGQKQGPRVGFCGLVVRFYPSRRDYIGMDVTDFTSHPRVCQNQEYYNGGLLLARNELLTIPVKIEALKRIQVSYPGIFGEQYNLAEEYYSASGVLDVHDKLLVVKMTLRTRLYQGFYEPYSYDQEIVDYEYLGNKDRLVVDDLFRNIVSRKEYFSKVSHLAPRLMPAKFLISTGHSSEVSDKVQHLNAISSVPDTKINSPPHNSQYIHPPDPNTIRLSPTQILFPDIRTWRFGILP

SEQ ID NO: 26184 - protein, 113 aa, Candida albicans
SNTSSTTNRCRFQWRLQSLYSTFKHLLAESRALTVWSLNKSTRNLGIAFLFSPHTFAHTIVNKFSSQAITHHQCISWTNSRTNNKRTGNLQFNKATSTSLTMPNKSNATTSIQ

SEQ ID NO: 26185 - protein, 61 aa, Candida albicans
NLHISNRRSNVLLQHNSILHFPHSLFISKISNMKVKFCSCSPSTLSIVVQSITMCVSHRKC

SEQ ID NO: 26186 - protein, 163 aa, Candida albicans
ASRNQCYEFHNMDTCSGVYHIYHHLCNHRDTYHHHPYTCHHIFCLCICHGIYHHHGIYHHHGIYRHHGICHPCNDHLCVCHHTCPCICHPIYHDTSYLCIYRPICHLSIYYRHHQQKHLYNVYIWSKDRFHHIHDIIDHLHLHKLNPNQCLYRTSHLCDISIL

SEQ ID NO: 26187 - protein, 89 aa, Candida albicans
ALFLIPHIYSVNKPPGMLQFKCSTFTKNVIYLKVAALILLQHRISSVLPFSVSEKTVEITKKESPIPTLHLNLQMDVRKQFISTNEASV

SEQ ID NO: 26188 - protein, 107 aa, Candida albicans
  UNSURE (97),(104): Identity of amino acid sequences at the above locations are unknown.
RKSESYQGFSKYAQEINAYHNPNQHAGLPINSEQPQRAQSMTSAGQAAAMALKLHSSPQKSQQQQQPQQRTAAQTQYARAQSLTSGRSNSMRRHTFXTRLTAGXGHV

SEQ ID NO: 26189 - protein, 68 aa, Candida albicans
VVGSASKIKETAIMEDDAHVITSDHLLTINLIRRRNLLLTISTEMCSNLEISNMQDFLFCFDFKGISV

SEQ ID NO: 26190 - protein, 115 aa, Candida albicans
VQSGGTRATAGTVYPILGYGCAGCQRLYHSLVPTYILGTDLLPPLARKSGLAGTRAGAEIKLGPEPEPEPEPEPEPEPEPEPEPEPEPEPEPGSGPGSMADVPKLKGNGQSQSRV

SEQ ID NO: 26191 - protein, 63 aa, Candida albicans
IKQKSLEETVVAKQKMNNYLLLYNNAKFTTDNNKHVYCLCIFSNACGGNVILLRLLLCLTPII

SEQ ID NO: 26192 - protein, 67 aa, Candida albicans
MDIDLENRFRSLIIYSSNFIMSLFLCFFNFYFYFLIIYLVSFPHNDAPIIFQTVVVSSAQVIHSVTR

SEQ ID NO: 26193 - protein, 62 aa, Candida albicans
LRLFTFGTATTVVVADDDDDDKIFLGDVFSECGDLGLKSVDRVSLLLPVLWVGLVLTLPFKR

SEQ ID NO: 26194 - protein, 65 aa, Candida albicans
SIVVCCNSCNYLVCHTFVPPSFSVSLRLIKFTKRYWKEVFVAISPRFYCGYESTKRKNGSGVGVE

SEQ ID NO: 26195 - protein, 72 aa, Candida albicans
YIQPSPYPYFYNMITDEQLNTIALTFGFASIILIIIYHAISTNVHKLEDETPSSSFTRTNTTETTVASKKKK

SEQ ID NO: 26196 - protein, 100 aa, Candida albicans
GCAWCNNFQYTHKKKRTSIIKTIFEVDQIVRIDFWLQKLIQQPSTKTTINTKHKKQRVIGIKYYTGKNKNQLIIKVSLFVVILATTLFVTHLSLPPLACR

SEQ ID NO: 26197 - protein, 77 aa, Candida albicans
CEDIQILIKRVFFFSLSSFSSLLVSLFVEVSFYYFLAHLKKKAALDSNLGKKRPIERKSQQMNKLNQKPLRVRRKVG

SEQ ID NO: 26198 - protein, 85 aa, Candida albicans
ISIYNQLELRRCDTHPLQIFTKYFRSVSNLSDHAELALRKYFFIWVCVQDIDSLDFRRITNQELAFINYFIAILTKYTHTLMEMQ

SEQ ID NO: 26199 - protein, 139 aa, Candida albicans
  UNSURE (69): Identity of amino acid sequences at the above locations are unknown.
ELKHSSSLNKISEYEKNGIIIGPKIEKVIPVNIPSSPVKPEPSHKNKPTEEKKSSSSLLSSYVSRKQEXKLQDTRSGTLSNYLLRKTEPTIPSKRSNTEPATKPTYQYKSRKLEAKAPKERVIIAEYNDNEKQDELYYE

SEQ ID NO: 26200 - protein, 153 aa, Candida albicans
PVLASRATNTSDLQRMFDGDDFTFSDDDESPEKEVRETEEPKDEDKKDILPESPKEEQQSKEVNPENEPGLFVNEEEEEKEEKEQEETRSGEQEEFITEKDEEGYLITRKVKPITKQAKPKKQVVPPKVTKPSTGKKTGMKQSSLMSFFGKKK

SEQ ID NO: 26201 - protein, 472 aa, Candida albicans
TTTHFMNFALSSPQTPPPKTKLPRIPNAPQSPTKLHTKSLPTVLEMTTSTPEKVAVLSQPVFPPLRAFDRAWSLTTDDSHIPVYDLLKLLHNLRLESLHDMHEDNELIHMDDMVIKSRIVEQTEFLANVHKEQAYQIIYQSLYDAKEILKNTGSLNLQYDIFNNQYDLMIMMASNNGSQEDNDDEDYDETATLMEMTQNSPLQEDYEDILIPQQISNWVKPNIKLALTELEQFHIKLNNQYLGLENDLRQIKLKNDLDLKELQVLVGKNDHLISKLNDIRDELSGINNCLMEYRDQFDMDSFIACDNEKTKEWQSQLLNNNNDSNNNEELMVSCFQSIDVIEKEVLEVDIKLSWSLDNTPLTTEIRISAKDHILVSETKEATPDVQQVAETVPKTDNTSGIETADTVQQTSIIPIMSDNGSSDDIKESNLVKSHISNPNVTEIKKKGKLSKHSHYIVIVAIGVIFAYVKSML

SEQ ID NO: 26202 - protein, 463 aa, Candida albicans
KCKSSELIRLIHEISERRINRLCSTSFIILQELEHIQLKFKSWEFLSLDFNSDNHFSNDDNNIKDFNAGVANKVISACTDLNVKIAKISSDIDLISKNSRTLSPKDLMSDAGTMLTSLLLRIIKLKNDVVEQLSISYSKARLIIIGEELEMWEDENTVMYYKSFIVALLQQLNDAVEQGDGDAKYECLAVINDLEKMFEKCRIEKLIDKTLEDSRHEHDVQEKQKGEEEEEEEAVQAKASVDETMTTMATTPQSTISTHGKTQEHLQHHFRYEDHLDSVDSETDYYYKHETSPDDMYSEYSMFSSSPQLPMVHSITSVKDQDSISNYHGSITEELPYLMTAFSSAKNFTNDVKHYKLEEEKENKPVKTKPIPVAVNPSPQPKKPFFHKTNLPNSSLYSESNVIHPPLYSSSVLRTFGIKPQVISVPKDAVEKKKTTKDKPLLLTEENISNLTQQQLRHHDYIY

SEQ ID NO: 26203 - protein, 322 aa, Candida albicans
KKFFPPPSLALQTNQKHVHGINIKSPLIQNRANTFVLMSSTSMDIDIFAKLAKLPLEIITIILDYLPKCILPKLLYLSPIRKIVASAILLDVEITEHVKRHERSNEPGVGFSKCDCDHMTFQPECLKQGVNQWKIFPRIIHLEYFFAFKLTYKIFPEVLYKALKVNATFFGYDSCDPDSDLKHFAESKVKFDSLTLQSCEHVSELPTVVTSLELDETILDNYEIDGLKKLILDLFGYENTTTEYSFASSLEDLTILDYKITKITLPPNLRRLYISTFLKSVDFVSEEMPHLEYLLLSLPDVKSLEDTGIHAPNLKTLEINSR

SEQ ID NO: 26204 - protein, 64 aa, Candida albicans
FISLTWLPILGDELLYRIRQEKKKKREWNNPEIVKGTNQLNNTRRFSHTNKSKIKLATPKRCCK

SEQ ID NO: 26205 - protein, 72 aa, Candida albicans
LLCISTLNYPKIILLKCFMKTRLYRTLLNILKEDDKPRKIMFHLASIRHNSITQRMSKHRLMLLIQNKLTMY

SEQ ID NO: 26206 - protein, 76 aa, Candida albicans
AAIVHVFVLPLLAKGAFQLHLQLNQQWVMDVFFLFFFWLQSTSQLQLPFTSDILLSLESIHDLLMPKSKSFFFSFL

SEQ ID NO: 26207 - protein, 64 aa, Candida albicans
QLGVTISPKNHSTAGRVEKCAQSHNFTEQKILGSRVSQFSCLHGLVRRCLALLRSLFHFRCIFE

SEQ ID NO: 26208 - protein, 72 aa, Candida albicans
LQKSPGNASNDVIAKHVITDANVKKRVTGGILWMFSTIVLAMVVSGEERKKKKKKKFPKKKSCLFDDTHTTT

SEQ ID NO: 26209 - protein, 71 aa, Candida albicans
LTKYLTDREKFINNEILPIKPNANETAFITTTFGMSGTFFLVIMSTFQCSTKATIDIIFAKGPRHAAINGK

SEQ ID NO: 26210 - protein, 63 aa, Candida albicans
KNQNSSIITIGQRKQTFNPVRKLSRNEGANTQSKIQTQECIISIDYCSIHDILAYWRANISKN

SEQ ID NO: 26211 - protein, 75 aa, Candida albicans
DDDGDDDDGKCCLYFFLWVLIDWVSQLGNFSKKKINCMLIGERERERKPKMFFIRSLLKEYWNLGKAGKKKKNFA

SEQ ID NO: 26212 - protein, 60 aa, Candida albicans
VFILHFVILHGYRVDYISFCFQFKVISSSQFIETFKIHNMQTYIHIKVFKVLTKNMISLW

SEQ ID NO: 26213 - protein, 69 aa, Candida albicans
LFLIKKITKYFNMYYILIYISLKGDVESGKKGTKKNIGQINYYHNIQLYKPFNLLHLFFSNINKEQDKL

SEQ ID NO: 26214 - protein, 61 aa, Candida albicans
HALLLCVKYSRCEIIFHIQNIHEIPDNTPILNHITIFSYKINSMFKSGTVGFQRDVPDPME

SEQ ID NO: 26215 - protein, 74 aa, Candida albicans
  UNSURE (17),(48),(62): Identity of amino acid sequences at the above locations are unknown.
SRDKIIMGKHNIAELFXRRQQQRLGSVMNWSRLLNKRPISRMKIRFLXYCLHSVSFFVWSAXDSFSFWLPVHFK

SEQ ID NO: 26216 - protein, 104 aa, Candida albicans
STPRKVTFCLPPLPLFLSNTLTMDKLQEIIEFPVTIPNQRKPYQLIQTASIINVITSLIIGIITDSIQKICISFIIQFIILLLLVSPNWLFQSEQSLEWLTVKF

SEQ ID NO: 26217 - protein, 77 aa, Candida albicans
RPLFPFPTTGAVIADKAPRLNPKKSLSIMSLPSLNDNLLSVPEVNPEVCPVVPGPVDEDNRSNDFELANNRFTSGST

SEQ ID NO: 26218 - protein, 74 aa, Candida albicans
NQGKCIIGTLPGCPLCENFNKTGFLVVYSLFYQTGLKEFPIESSFPCYYGIAKRCSSVFNLHSHTLLLAEQVLN

SEQ ID NO: 26219 - protein, 98 aa, Candida albicans
ITIKIWQPKIYTNIFFHINYNQFNIPKQLQHIIIIVTIIAVPMGHMDVNHTYTLSMQLYIEVLVQQIINFITCNCFSTIIVNTNLYQYKILLDLYSES

SEQ ID NO: 26220 - protein, 91 aa, Candida albicans
QNPSPIYLLNKYFNFVMKSNKEWVTTIHKAKFLELGYGLVKTTLVLWIMLLYLLFPIHDNSLFWPYGFILSNSGAALIDVLDLVPVLAFGR

SEQ ID NO: 26221 - protein, 72 aa, Candida albicans
NGSQWNLYSIGTNSINNHCHFVTNNLKRNSSYLITTEYYRNIDILSQFVNHASLNLEGLSFLILNHREIVLG

SEQ ID NO: 26222 - protein, 106 aa, Candida albicans
LLALLVLGTLREDPESIVQLNRNYPAIFLIFLILLSNKLVSPSLLNSFTSYFVSNLCIYFYAVEISVSFCYASTSVRGHLNIQGGIRCLLNLHLAQVPVNIMVICE

SEQ ID NO: 26223 - protein, 74 aa, Candida albicans
VLSFNNQSKVTTIWPNPEHHLPKASTGTKSKTSINAAPLLDRIKPYGQNNELSWIGNSRYKSIIHSTKVVLTNP

SEQ ID NO: 26224 - protein, 246 aa, Candida albicans
NFLLFAMLKNWDINTYKLREFSDSFYHYCCFLLFYIDPFIAWLLFDFFVSITTTMLFPIILILSIFANFIQCQFQPLSEPFILAAYDPDYSPYDDNKIMNQNIQRFGYNKTKVILSKHINTTNIYLEGRILDNSSYQIDATLKGMFIRVDKFTHRLKLCPNGKTSKYFSIEKDMLFYKNDTIWSVCYDEFEDVSYIYHGSIDDNKKYCCPDNGKEIILRTLGKYDASGALPDYTKHPHKKNSNVLG

SEQ ID NO: 26225 - protein, 180 aa, Candida albicans
LRTKLVWFNFKMNNYFTKYIPNIRLSNTVDSDDHTIGNSTNSLPHINYIIIFNPTFVSPKAESDEELIKQIIVFLQGKDLPESQFSQIEQLKLIGLLRGIESLGESFSNSTTSTTTGKKPTILKSLDSSTVMIELESNYFLACNITISSQINDQTVNGINQQLLKSIMQSQRYVELFNKS

SEQ ID NO: 26226 - protein, 73 aa, Candida albicans
LKMIMFEIYLYEQGVNNGTKFGLYLLELENFISYGSEGILAFFSSITLVIINNGGINFLLKSFEGKVYYLMVW

SEQ ID NO: 26227 - protein, 63 aa, Candida albicans
LSKTFIVFCLSLPCYILSMTIESKNKNLGSSTVIASNLEQFAYLNEKIPLSYLIRALFHVLIR

SEQ ID NO: 26228 - protein, 72 aa, Candida albicans
KKNPQKPIILYIFGKFSGQKSLSLSSIIPKSIIIIIIIIIILNHTKIKKKQICHNYDFSQTLLTFLVLIVWL

SEQ ID NO: 26229 - protein, 78 aa, Candida albicans
THKPWELKKKKKKKKGARERERGREETMVVKIVSECETPKVKEGSCTCYVVVVHDLDRKKISFFSLPFPFSYSLFLCV

SEQ ID NO: 26230 - protein, 97 aa, Candida albicans
LTNHIPPNIYSTSHYIRFNNHFLTTQESIKQSKQEKKRREFKQESRSNTISINFFFLVFLVISFDYSILFYSIKEIFIQENQLLSLLFIIIINIFSI

SEQ ID NO: 26231 - protein, 222 aa, Candida albicans
FFLPIIMVSLNIDSIGIIGAGPGGLASLYEFLHTNKDGTSTVGTGKRAETPAFSKIVAFEQKDHAGGIWAPATPDADLPIPPQEILNTGKFNDPAIIRPRNEPPQEINGATKETPIVVAVPKSKSKTNDNLQNELEWKRSGVYPYLSTNIPSRFTRFSYLPDEEKYHDKSRPIYPFLYHQELSQRFTDFVNNENLHEFIRLNTTVEDVHNSSTYGNWTDPRL

SEQ ID NO: 26232 - protein, 71 aa, Candida albicans
  UNSURE (57),(64): Identity of amino acid sequences at the above locations are unknown.
HLTPEKFFCNKTKQETYKNIYFKLYKSFIQSNGAISGKPFLLRTKLLFKPIAPSFFXFYEDWQXLVARQRL

SEQ ID NO: 26233 - protein, 78 aa, Candida albicans
EREIVKFPLFFCFLDLSFKRVSIDCFYTLELDFSTAKETTPSERKQLLHMERICGVEFERKKKERGKRKDIISNFSAG

SEQ ID NO: 26234 - protein, 72 aa, Candida albicans
CLHYQILNFNEYNIKDDTFVLSNHKICAQNSLPDVLYVHYLPPSDHSGSLFLISNQSSCQAYVVSISVVNSF

SEQ ID NO: 26235 - protein, 73 aa, Candida albicans
YTFFQLFVIPLKCIDSRLNAPIFHQEDTRLFSCYQFTRLYIPMEGSSKIERRMWLTVLLVCCPAIYRCPFFFF

SEQ ID NO: 26236 - protein, 61 aa, Candida albicans
WKLSALLLWLLLDALDGVSNFDGSIDPTVPDILLMLLLRSRSSSSSSSNNVDSLDGELLYD

SEQ ID NO: 26237 - protein, 317 aa, Candida albicans
  UNSURE (37),(39): Identity of amino acid sequences at the above locations are unknown.
KILSFFNILFSFSFYFPFSPFFYLLIMSDIELINPDXYXQKKKKRYQETPILHTLQQQQQQQQSSSTSPKQPHQQQQQYSINTSSFPYRRSPLHPTSKLYSQPQQSFNSEWVEDQSYNNSPSKLSTLLELELELERERSNNINNMSGTVGSIDPSKFETPSKASNNNHNNNALNFHYINTPVSHHKLDINNTTTNKDNYHYNDNDNNDEYIEKASTTSSSTTITTRLPKVSNWDIFWSMLNDLVGKDKMAKVGQYTLRLLVYHAGKSQTYLSDNNINIKVINERYNDTTKKLNVLKNFFNHPADVIKNHCYFDSFNF

SEQ ID NO: 26238 - protein, 92 aa, Candida albicans
RIFSIIQLMSLKIIVILILSIFKQKAAGMINGLSMYRQFLRIGKTTFRIRDVIVKFHHNVFNNSSDNQVQINKSKIFDRKTLGTILTLNYGN

SEQ ID NO: 26239 - protein, 151 aa, Candida albicans
PGHCETWVSLYIMLYENLQNLLQQEMDLKIQIQVKDKAKQLSKQILLGGNAKCNDSGGLLGFNISTIPTVNSEDAKNLTQIQFKKNNAWIDIYKNLSDLAFNTYTVFNIALPFDTWQIWMGISASVLSTIKLYRETKQKMIEKELTKLKSD

SEQ ID NO: 26240 - protein, 69 aa, Candida albicans
DLPQGEAEAEAEKNNQIFNPHGFKKKKISNIAFLLSTNKHKIIQLQFFLNKSRLQLISNFNFLKNLILF

SEQ ID NO: 26241 - protein, 203 aa, Candida albicans
KRSIPVNLQGLFLLLVSKAKKFQRERVFMKGIYLTLALTKTFCDSCRGVGHSRWDCKSVKYCHRCKSTNHPTGKHNQFIKQQTKKQQQQQNSKPSNNNTTKTNNNKRQRRDKSPSTRVGRGFILENSSTIEPTPRTYEQELDSFVRRNKAQQQQTQSQEEGDTTRVIGQQPIVPTQADEIVKIVEDENMSDDEPIRVVANARQ

SEQ ID NO: 26242 - protein, 183 aa, Candida albicans
TNKNNFITPLFPPTMPENLQTRLHNSLDEILKSSGYIFEIIDQNRKQSNVITSPNNELIQKSITQLLNGEIQNFHAILDQTVSRLNDAEWCLGVMVEKKKKLDELKVKEEAARKKREEEAKKADEAKKCFILLFCQICTTFNLCANILFYLIFIYFYFTILFYRTFYIFSLSTHLLYNIFLQL

SEQ ID NO: 26243 - protein, 102 aa, Candida albicans
NKQKAEARKKAETAPQKFDNFDDFIGFDINGNTDEDMLSNMDYEDLKLDDKVPATTDNNLDMNNILENDELILDGLNMTLLDNGDHVNEEFDVDSFLNQFGN

SEQ ID NO: 26244 - protein, 266 aa, Candida albicans
TMKCFAAVEQYQLTFCSINIERTNSTSVMNTILEKYDIIFLQDISPNNTTTLQILTTRLPITVIQSHSNDKTAIAINHKIENLIKIIETNTLNLTEQVSQYVNDVIIQIQNTRIILVSVYYPIADKAPMQVTLTQQLNNELPKTYPIIMGGNFNHILNLATDRQTYGCDKQGEDKSRQESLDLYNNHKLVDVFREFYPNKIWATNKNPQNNRRIDRFHVSSQLMVQIPRFQQIKIPKLKSTHNAITFSYNLEKTQLIGYWSRKGYR

SEQ ID NO: 26245 - protein, 66 aa, Candida albicans
DRMFLGSAGLRPHFFLLEDRRKESAHTKSRPQKREHTHLRPQKKEHTFKTAEKRALISKTTFLSRE

SEQ ID NO: 26246 - protein, 66 aa, Candida albicans
ECGLSARGEHDRSENSLRFVSTCRPLTLSTNALAQGFVFLHEFVLTQITYQKLYTIIPHNIQTKYS

SEQ ID NO: 26247 - protein, 62 aa, Candida albicans
CVMTEIYNIGNQYKDLPLQNDEVPSVFSTSWSLFICSGLMIIIAILVSDKKDKRNIDDIYSK

SEQ ID NO: 26248 - protein, 65 aa, Candida albicans
TRQKEKILHKMEFIFSIIESTNQNQTKGKKRTKKKRNTRKYRAHSIDNFQALRSLISPFLLYRPA

SEQ ID NO: 26249 - protein, 62 aa, Candida albicans
CSNIYFYFYFSLVLAGEKDKQRKNKPHLYFLHATDTHQEDGKSHEASNQTYFFFCNIYTTML

SEQ ID NO: 26250 - protein, 78 aa, Candida albicans
FHFSWLMHLFAFVSRKKKIYRVLPISIGNVSHCLELACFIYELKSLFNLQTKQEKQTIDSLVLILVELCLRRTIVSVN

SEQ ID NO: 26251 - protein, 69 aa, Candida albicans
RRTGTINQFCVKNILMNEHLRVIITIVKVSVDLLYICGELRMHSTFTPCSTVIDYSTIFLDYCCHPAAT

SEQ ID NO: 26252 - protein, 82 aa, Candida albicans
RIPFVFSLVFFLVHSLFLPVNNLIHQRRAHVLPGFLNNTRANTQNKCFNTYLTVSVVQYLVSIPLFFNPDDLRKLGRYEGRK

SEQ ID NO: 26253 - protein, 78 aa, Candida albicans
TKYFLVSFLLLSSLSFKIDQQDQYLTTTNHYIKLHSLCYVTGANGVTINVSTRVEVIFCILQQTTPHIRFPFFFFMSI

SEQ ID NO: 26254 - protein, 65 aa, Candida albicans
LHIPVTYLVDLYLLYYYTNLFRFILDLLICYQYSSDRIPIHIWLRSTTSDIEIHYIQFLEMWLAG

SEQ ID NO: 26255 - protein, 69 aa, Candida albicans
CLITKTKKIINMDNFSDIKLSNSKQKNSLSNKKNQTKLTSKNSIFFFLDVKFDYILPPSNSQIQYITYK

SEQ ID NO: 26256 - protein, 109 aa, Candida albicans
SILKLSEDNKRNETKKYFVYYILPYQKIIETKLGSGWAEEILLSQVKNYNHQDVFEENKTTHPRKSCHSLSLQYISLHGYIYMFCSANLPASQPATFPKIVCSGSLYHL

SEQ ID NO: 26257 - protein, 68 aa, Candida albicans
TKMKNNQKNNQLCSVNSLFYIWMYIIMLILFGNKTNYKVIFFLSLFLSLFLFCCFEFKFNSVLSIRKL

SEQ ID NO: 26258 - protein, 129 aa, Candida albicans
NQHRYIKKSAINYPILLAMTHLIEEININGIDYTIVITFNSKTHSKAPMSIYINQQGNQEMGDYIYTISSYSTYLNNLTNNDQIKLLNQLLVKKFNVPIFLNISGDIGTTSNVELFRSIVDLVEHLKLN

SEQ ID NO: 26259 - protein, 95 aa, Candida albicans
WTPGEHPSTIHPTDLQCDSPYVVTLNNVPKDDMLLLVVIDLSLITDVDMFKNKFFKIFFFSTAKSVLIMRKKNGNDSTKILSPYYYSCKLTHKHP

SEQ ID NO: 26260 - protein, 62 aa, Candida albicans
RIQIKQERKKDIYMRVKERPVIILRFKSLVIECGEKKNRSNGLKWRNKFELIMCGWDTGEKN

SEQ ID NO: 26261 - protein, 61 aa, Candida albicans
DYNLAFKVIIGLEGGERRLQQLVKKLLPPGGKKRNNKESKKGKLSFANDRIKNNIEIPFLF

SEQ ID NO: 26262 - protein, 60 aa, Candida albicans
FFFSSVFFMLQSQNLSPGKGSFILKFNVATFKFLSKDIIDSISCFSLLQNCCFLAASVEL

SEQ ID NO: 26263 - protein, 83 aa, Candida albicans
RLYLLNISRSESPMVDRDREIFGVHTSKDMAPLDNGVGGFSTVRRSMQINRTSEYDNEKSVGLRRFDSFEIDSGDEDTRNYRH

SEQ ID NO: 26264 - protein, 67 aa, Candida albicans
VNDIWNKEGEIKSVNRRVFRRVSKQNGIIMREREGGVKEKNYKTNFKLHPLSDHQLEYSFNNVIKTN

SEQ ID NO: 26265 - protein, 109 aa, Candida albicans
NFEYEMDNDIQFTENDHNVHIKQLDLNFIVVIRLSREVLSAMKLSEIKIKSPTKKQQISTKREAQILQYNAQLLMEERQSRYSKRTGLTIDSPTASPSGSPKKKKVKFV

SEQ ID NO: 26266 - protein, 93 aa, Candida albicans
  UNSURE (15): Identity of amino acid sequences at the above locations are unknown.
ILSLLKHQLGRTLYXQPFGSGCWVVFEGKHTTIEAKLENRLLGYLTAEANEQKITDVVLGEIDGKPGLQQVKELLSGEREKVKRQAQLNLKNN

SEQ ID NO: 26267 - protein, 333 aa, Candida albicans
ADTNYTPNLDFDPTTFTAAQLRKVLNLHEIQYDSSAPKSSLIEIFNKEIAPNSKKLLSEYNAKVENMNDDDFINASDFDKPSEKSTTSEKASALFVSDTESDGENEKIDVSKTRNKTKKVTKPKLRASSGNQKSTSRSSSRTKSPESESDTESKDDEAKPASRSSSRLSSRGNRSKPLNSLFDLDDSVLNLRKPSKNSKSKLRTTLKLKTKKTAESTPEVTETSDTEKEKVEEPVKKETGKESTPENTNFSKENVFQSPPGSSTKKRKHQDAEEEEDDSTLVKKIKPSQRTAEENRSLFDDDNDSDVEFLEEFMRTQKKTSSSRRDGRSALKG

SEQ ID NO: 26268 - protein, 65 aa, Candida albicans
FLDCSSLMSARISGMMYTTQCANEPKKTKTNTNSNERKKAKKNSIMLSNNHHQGQKQKNIKKVIL

SEQ ID NO: 26269 - protein, 66 aa, Candida albicans
NRAVFLVVYLNLMVINNRTQPSLATLPLPKSYKPNERVVNWLVLLNDFKVGNYSFRNFIKFWLKYL

SEQ ID NO: 26270 - protein, 92 aa, Candida albicans
HYYCQNHCVSEHGKSVILFGKEGTLSAAGEEEEKNTYALSFFDTGGICVSLVGMYIWGLVDTSRDPPELLYLPKNLRIALRLPIAIIIVLFS

SEQ ID NO: 26271 - protein, 66 aa, Candida albicans
AELNTTLLMGLVNMLLGMLLIFESVVGTPRSCLFDSTRPKKDTSTNTNTNNDANNNANVNTNVNSD

SEQ ID NO: 26272 - protein, 79 aa, Candida albicans
EKRHENPNRCYRNHPPMNPQSTTKIRPAKRLMEASGKCSSEGLAYGNCVLNNYTTIKKDLCGQEFIKFKTCVTNQLAKK

SEQ ID NO: 26273 - protein, 69 aa, Candida albicans
NIQSLVLVQNNVHHTIQLKFICKLQSRKEKSNNEEKLIKKNMQFEQLITTIMKYRQANETRKRQGKKCH

SEQ ID NO: 26274 - protein, 65 aa, Candida albicans
VLVVLVVRSSPSRDEPGRDVVDLFDEMSNDTNDFTQKKKLRGEEKGTLMTGDKVNYETIITEFCK

SEQ ID NO: 26275 - protein, 62 aa, Candida albicans
CSFKTRIFHEMKKMNRVTSNKASNGKENEGEEDDDDTDTRSMGSNRGRIIDQYIYLQYNVFI

SEQ ID NO: 26276 - protein, 92 aa, Candida albicans
STKQLLTNSQSFLPKYINDTTPPTITLKEYDNASWASTTCLDHNPIKNQYIVVVMENPNQIVAIIDQQDNMILDILFKNAHDAHSKQEYSTK

SEQ ID NO: 26277 - protein, 62 aa, Candida albicans
FIEFTNAKLISEVMATISEKHRVYTKQSNRVRYIDLSLETSIFFLISKFDQNFNSKKILPTG

SEQ ID NO: 26278 - protein, 110 aa, Candida albicans
NQIEDNIHNILTSWLLEILSERITITGYFTRNIRSTVNDLDKLDFNYLYVVFEFQGGIGMFVVAVSLFSRQIRICQLYIHFIRNRHTWTALGGATLKPYPHTIEMMTLDY

SEQ ID NO: 26279 - protein, 72 aa, Candida albicans
NKGTSSGCQFQGGNYHKNIYTNAYIKPMIFKVYLYWEEEVIATSHTPQFFFFRSATIFTTTTIFFFSLVILH

SEQ ID NO: 26280 - protein, 112 aa, Candida albicans
LLIVYIVLYYAVLCCVLSCFSFALFVGNTFFRTTTTIVICRKAMYRRTLDIMVTTTSTYVDIYFLTVHGLAEYSQRKCRPPGSYTHPGTLHVDIHIAQQYVVRLPACRKQLS

SEQ ID NO: 26281 - protein, 72 aa, Candida albicans
LILVIKLVIGFIEICHFKILLLICHYYCFHRITNYITRAKQLKLMKKITNPIEILVQDFNTLPSSYIHLYKT

SEQ ID NO: 26282 - protein, 301 aa, Candida albicans
LLLCEKKCFQQIKQKKNKIEHNTTQHNTKQYILSTVMSDSEKELTVEDTNVSDTELSKEERLEAARKKFEELKKKNKKKKSKKSKKSETTEIEDSAEGTPAPEDKPEDKSEEKAEDKSEDKAEDKKDSDVKEDTKEAKEEITEETKTEKEDQPKVSEEAIPESLSLSLTSELEKQVEELKQTIEQQKSTIKKLRDENTDLKLSKMDLNDKILSLELENKNLKALTSSASSVPGGSPIATYKETFKPAKPVFTKNDYASSSQQSFSKSNATEDFREKLMVWKGWQVDMTNWNGSGATQKVAL

SEQ ID NO: 26283 - protein, 346 aa, Candida albicans
IFGGFESDDFKTTTSTTSSSPQILLTSIEAFTARVKDEQAHNSGPLLKCIDLLIDKYQPLLVEKFKIDPSLISDPYVIQQRIWDNLKIKRSQSLDPNIKIRQELMEKNTNEMIIDHQSIPYRNFIKQLYPLKSLHSTNNKSEYFDFVNNSKKYLSISHEELYKRYLDLPHPAPRFLTFDDLQNFIYKFVLLKPHYSNRNVIEANIFKNDYQSAINSLNLEIEKRQIYHDMCGKIINDLKLANLPITQPEQIRLIYLSFFKDRQDLLKNFNPRQLKLLNYPQFNWGNYQMLIKLFGDNRRDLLSVLLLLGTRHDQFDIIQDILPKVNLGCIFDRANSTTTTANTSLK

SEQ ID NO: 26284 - protein, 141 aa, Candida albicans
  UNSURE (9): Identity of amino acid sequences at the above locations are unknown.
TDNSLRHLXYYFTWYIDRPNFDTYLARTIDYITNNIPVLTTDIVNSISQTLIELGYIKQAEKLFELAFFQDPKPTPPEYENSESISYKRLTTEDSIINQEWQFIYTKLKSITNDNTIIHKLIPVELTFLNLIDRILHIWKL

SEQ ID NO: 26285 - protein, 225 aa, Candida albicans
LIGYCIFGNFDQIKQLINIMDNIAKQPLSTRIYIRIFKAFINNSSNGTNQQLENDWTLDDLSSILTRLINDIDTIDEATTTTTSNTSMVKQLLNEGSLNFNKYEQEIINRKSNSDIYLEYQNNGGLKLLRISNYLLEVIFISLETKLHQVFKSTRSNDIEQTQNQYQSAIQNLKILKTNWLNMLEQDVKKRNNSNSINSSYYYSDQLSYINKAVLFEIFSIISQL

SEQ ID NO: 26286 - protein, 69 aa, Candida albicans
CKIDKKCKIQHYLNLMVINNRTQPSLATLLLPKSYKPNERVVNWLVLLNEFKVGNYSFRNFIKFWLKYL

SEQ ID NO: 26287 - protein, 256 aa, Candida albicans
SVQWAVKNKEVFEVKEGEEKQRLENLKLLQNIAELQKLETKVNELTNGNKSLETKNTTLKKLTKEKENKIDKLSSQLTSSRSKYASKLKSLELETGKTIDSLLVELKLVKDINEKLLAKDASTMETLKGVLTTTYDSLYDWLFTDSSANCYLDKVYENRYLSLLNVLKQTKDSNEIYHNSMHSLLMRIWTSMEKLQYLPAENLAFFRALIKEFYQRKLLKQDDLIFIKKLLDVFDLLMELINEEVVMSSRPSRIVK

SEQ ID NO: 26288 - protein, 71 aa, Candida albicans
TNIACLINLPDSIEILDLSYNRFETLLVNNNGDFFVFPKNLKYLQMVGCNLLPPQTIKNYMEFPENLEKLN

SEQ ID NO: 26289 - protein, 108 aa, Candida albicans
SKFRSLKINSWFLYFRLKHLRWCFSFGLHNQLVGNDSVRDALKEPENEFNYGTQPDFDDSLVDDDNSELFHDYIDQKHSNDEKYRKERRKKERLVKLNEQLDELNLHQ

SEQ ID NO: 26290 - protein, 70 aa, Candida albicans
KKNGVLLISISRRNLLLYSHKYTHNTLNIYNHSNKSDLLTNSPVKTVRKSDLSYFDPSIPRFHSPFVTRP

SEQ ID NO: 26291 - protein, 72 aa, Candida albicans
LINRISYGIGKHIQLRIQLNEVGSVTVNRSGKTFLFSETGTVSGIRIIFSNGHITASTSSTDGPEGQQIRGG

SEQ ID NO: 26292 - protein, 277 aa, Candida albicans
  UNSURE (80): Identity of amino acid sequences at the above locations are unknown.
HSLYPLIINDMNKEIHEGEKILLGTILRVPLIIEDKATSETIKNSSLWLHVSGADYKPSNNPLFINKSLTAICSEGIFHXTLTTDNSNRVIRRYIPNIDLSNDKHFELLNNLFPLDLESLIEAKQTTKDPTQQQQQLKLMAKLISDKSNYDANNEYLDDIEPNKNNIVLSIKTDAKYAVTIGTIELPPTDIENHPYLNDEENLLNWMELYNSQNESLLELLIESNNNLDRLKSENQKLELNLELTKNDYDKIIEDLELKFYLVLNSKKDKIYELTHK

SEQ ID NO: 26293 - protein, 60 aa, Candida albicans
LYIEWTGFEYYLGKGKIKTKKKELHKKFSVVPIHSKARGTVRRKRRLFSFFCHISMRYQS

SEQ ID NO: 26294 - protein, 68 aa, Candida albicans
TEIEFVFFFFFPLCAFTWNSVIRLKALNEAVLIMLMLRLARIKVRVTVFLVQQNKWDIEAQKSAFCWL

SEQ ID NO: 26295 - protein, 89 aa, Candida albicans
  UNSURE (32),(33),(34),(84): Identity of amino acid sequences at the above locations are unknown.
IKKVGILTNIVPLLIRTFNKRTSPTEKYFNNXXXFSAFKKPFRLKNLKIIHLPPWQQSSHNTAKSISIVYIIYKRFLIASKLIXITLFK

SEQ ID NO: 26296 - protein, 79 aa, Candida albicans
RLRNQPFAGYRILSHRYDLNSGSNVDQIYQIEQIFTARPLFFLFQLTKSSSIYVVYLIHNLTYSRKEYENQSGKTILSF

SEQ ID NO: 26297 - protein, 74 aa, Candida albicans
KHELCPSFLSFTIEFPSEIKILRYSFISTFLDAVSGLKLGNEPLTEVIFVRINYKYISLVFFNNLDSNNQHPTN

SEQ ID NO: 26298 - protein, 77 aa, Candida albicans
KTCLMMVTFFVVSHLSNHSQLSSGGLFFFFSLSLSQQTDKKYTQLVLPIDPTTIQITHFLIHQLQPISYVNTFYISS

SEQ ID NO: 26299 - protein, 75 aa, Candida albicans
FSPSSSSSGGGVVKEGKKFKRKKRDILKILLLSANLKISRVICANLRDFFFLLSSTTSTELLPHKVILNETTRNN

SEQ ID NO: 26300 - protein, 114 aa, Candida albicans
IIVHNIYVVIVIRPMNSIQPPLQIYFPNDLKIHYQDQGYWLGYKLNNIYIVFSLVVNDKDLKLPPELSDLAIIGTHNQKTTKQREGGYSNYDLNLIYDHTNQLLINQNQDFQRP

SEQ ID NO: 26301 - protein, 82 aa, Candida albicans
TFSKKLINKNRTQKVVIIRSNWLSFAVVVVMFHLRLCALFGSLYSNFNLPHRFIMNLVLVDRTPLSLLYLLGFWGSSPSGII

SEQ ID NO: 26302 - protein, 111 aa, Candida albicans
LHMEFIAFTFIEDSILLRLFLVLFILLVTYAVIIYLIETLFINRYPFVNINTDKVEASDLFLSVSLARNQTTKLLNRETFYKNLNNSSQYLRRDSYSANEFYSTPTTNIFS

SEQ ID NO: 26303 - protein, 67 aa, Candida albicans
FGHYWRYGPVFLGQITQTTNPVQPPNFAGSINNPSGGVIDQPEINPKEFPNWGFPVPPMNWGIKRKW

SEQ ID NO: 26304 - protein, 197 aa, Candida albicans
EMKFTSLICSSILLIIPTVMADDASSDTTIINTITITKTLYTPEESSSLLSVQLESEASVASVASAASEAAASAASIASVASEASAASLASELSALAKVTEVKADVINNYNATINSTLSSSTIAPKISSSSSSSSKKHESITSVITSSTKDNASAAVTTKTGSTTSKAGAAAMAGPVPILTNSIFTAGLLALAAVLL

SEQ ID NO: 26305 - protein, 60 aa, Candida albicans
EACIIGKKCRTNLNFNGNFAYVLLYYPVVHSIKEKYTKKKVPNSFLDGKKEKRTNESMNQ

SEQ ID NO: 26306 - protein, 62 aa, Candida albicans
QFFRGIEVNTVLMKIRSTHSLEDFLVSINYTKHLTRHLHHLLSSRADKLAFPGLLNLISIHY

SEQ ID NO: 26307 - protein, 102 aa, Candida albicans
KAKKKKKSMKTLSFYNKTAARASNPAVNIELVKIGTGPAIAAAPALDVVDPVFVVTAALALSLVELVMTLVIDSCFFEEDDEDDEIFGAIVDELKVELIVAL

SEQ ID NO: 26308 - protein, 97 aa, Candida albicans
CGYVKDNELLELNEKDGTTNVEKLDEVKISLWSLDGRDDESEFKLEDESKLLAGSLVRDTESLEISTVDVINEIDWLSDSPAIVCGKSSLGRMVLDG

SEQ ID NO: 26309 - protein, 144 aa, Candida albicans
DEDNRESTISLFSLIPGSAAIFVCYMKTLCPDIVCLFRNTSVLCSSGVCFVNVNEKNLRCIRCIWHVDVSVAELLCSLSAIDSKDLPLTTLKGEWHGDEWWWPSGVQKNDILSVLQPNKRKKINDYPVVLITVFDFRVFVVAHK

SEQ ID NO: 26310 - protein, 60 aa, Candida albicans
KLIHQRWSSFQMEKKNYARKNNLTKMKWETKNKINKTTVLIALQNIFIITTNSLGSKNPF

SEQ ID NO: 26311 - protein, 67 aa, Candida albicans
AGQVYRIRQGMPIIYKFIFYASCSLIEAIIRIVELILIYVFLWLSQFCSVHYSTVLYLVKLNKLGVL

SEQ ID NO: 26312 - protein, 65 aa, Candida albicans
  UNSURE (19): Identity of amino acid sequences at the above locations are unknown.
DQKLVCKTNQLNAIKTKLXQSHNLQLEDSRYCKKYYSITFKLDGKTDSYKTIQLKVCNHTNMCLE

SEQ ID NO: 26313 - protein, 444 aa, Candida albicans
GEDFKNYYNVFDYLSFLALKSTKSENFQNIENAVFNYYLQNYFPRHATENVAALNAKYDGGKKDWLIFFKNGDGFCNYKSLRNIKQILYLIKLKQPLSTFPSEESFWKNYGFGISTSPMFHKVRINRLIDDFNLLFEGLTFQESINQSEFFKTFLTEYTKETLIFELKQRIGEQLDFDKQSLGEVTYKLNQIQEIEYFLEYSLNNFQKYAYLFARLAKLVCIGDSKQVDCRNVLDTIMYRFNKTTVFDDIFTYSEVNNQAGTLGVAREYFYWIQMHGDELLHSIQKLVSDINSWKQMYYSICHINLELKLMEPHNTVSQELQDNSNGQELLSRRDSSLSINPIPEEELEDDNLGFLSNFVGTSKKARYKKLVVEKSEIVKNIMKLNLEIKWSHELIAAEISDFLKFRTEFLRFGIKRYISEEIKLLKQRSTELSKYVFLVRKDK

SEQ ID NO: 26314 - protein, 71 aa, Candida albicans
FSFLLIATPNPFTNQGLYTLIQRINYILFVSIKIQSHNQSINLSIHALEAESITTGVKFFFYLLSFISFLK

SEQ ID NO: 26315 - protein, 76 aa, Candida albicans
QNKIKTDIESNPLYINTILSCYIGKHTKQKNNILTNNQQLENKFWFFPKQHGLPLWTNIEIQLTKSCGQFYNEVYH

SEQ ID NO: 26316 - protein, 92 aa, Candida albicans
LRQWRKERWQLGFVRLIYIIITFFNSLGLQVHPCETLQTIDSHLKNTPTCKYNLVIQYLCCWFGLYGLPSIFPQFSVRPNIYINNVQSCKIK

SEQ ID NO: 26317 - protein, 125 aa, Candida albicans
PFVAKPMITNQQFNDNIEEFISIMLANLKLKGTDFEFSVNNNYVNKWNIDKMYSFVSVSVKQLRIDFTISFDDLYGVPLLNMRLYDNDTFLTSPMAQRTLAVGICPVDLHNHHLLQQPWVASASV

SEQ ID NO: 26318 - protein, 70 aa, Candida albicans
TNKEEKKKPIQKFFSIKELEETFKSTKFKSINNGMFNIDIIHRCTCILMGFIIWKVMFMGVLFIKIWDKN

SEQ ID NO: 26319 - protein, 215 aa, Candida albicans
IQDNQEITNMSSQVPESEALKIKYKEIAALKKAIQEKQELKRQQQQNASKIQKQAYKRILKLPVNPNVFLQQKPKFSNMTLVVNNTGGSTNGTTSTTKEGTSSTDQQGYVSVQSSGGKSFYNINVYQQEAEKLKAKILLKKKQVQEQKRLEKIRYQIPKFRTMSDNCDRIKINGDKYAVTENGRALVPIRMFQLTNPIECIWNGNKYQRNSQGSV

SEQ ID NO: 26320 - protein, 62 aa, Candida albicans
ISARVYYLSNNIIIFNVERERRRKIEDEEGNLKSCIIIIIIIKWRQYNYAQQKRKLESPITT

SEQ ID NO: 26321 - protein, 71 aa, Candida albicans
LALIALGSGTNGVPKIFNIFQIWSNSLEPGNRGTKLAVSTATAPKAQISIGREYHFCLSNISGDRYHLVDT

SEQ ID NO: 26322 - protein, 93 aa, Candida albicans
IVIFVVVVVVLIERKEEALFDILTHSDDIFIPYYTHKRTRPNSKFQDHGKKKLQPTKRVYCKKRTTRDKQQLKKEKKSPPRHFMINYCCCCCC

SEQ ID NO: 26323 - protein, 70 aa, Candida albicans
TITSKKTKDNRMREFDCLPHTITLIAKDISNQYSFRMITGSQYKLRMKEMYNNFKYQCYHCQASWCKPFS

SEQ ID NO: 26324 - protein, 77 aa, Candida albicans
KVSKMMKGFKNRLTRNKGQSTNKKTEKKDKEREKEREKPEKRSSSPSSLSLNTSSFFPAKFKEFNDKYFWIVEIQFS

SEQ ID NO: 26325 - protein, 61 aa, Candida albicans
YSLKNMIMKTSVVIYSFYKKEFQERVEIEIKKKKIKKKYCGFVNIKSMENKYFYNASLFHS

SEQ ID NO: 26326 - protein, 82 aa, Candida albicans
SWLPLSSITNLGKLLTGLVLVEDPDTFVDDTAFDLVLTDVALDGGVLKDDVRDTVGEGLPVDGLSFEEIATGCVEDPVGDAI

SEQ ID NO: 26327 - protein, 63 aa, Candida albicans
IINRKTKLADKDVQPGANSGSGNFCVMYTGRQKFFLFIFGLLITSPSDDDGRQYSNYEPVYVN

SEQ ID NO: 26328 - protein, 71 aa, Candida albicans
ITSKLYIDERVWSLSIHNNDDSNSLIESMHVSSTIGIMSSIKVRLFKLVSNRSKLTSIFFSFSHYQLSHRH

SEQ ID NO: 26329 - protein, 62 aa, Candida albicans
WYCWECNLVISFKEWLFFERVFGKILSHIWQNTTRKNVKKGQLHAILQKPNSSPRTGRSHLR

SEQ ID NO: 26330 - protein, 71 aa, Candida albicans
VKNILMVTNQMMKIMSEHDQNGFFYLFIFYIHINFYLNSFFNQINIVFIFQFFHNRIVNVGTHWSQQTFFG

SEQ ID NO: 26331 - protein, 70 aa, Candida albicans
FIQGKKSWLLLLYFIKLSRFHLMTKKFSLFHDKYIYDHSKDSVGFGPVQLSTEFIISFSNSIILYSCCRI

SEQ ID NO: 26332 - protein, 146 aa, Candida albicans
LIYFENEYKGIFSCLNIVSERFILIINTTNNKLNKTEFSSGFLNAEYFFQDTKTPNSVLIIVEVWAILKLLNLPNQWSMLKQYSNCYYYHYNYSSLLINQFRHFASIAENITNHKVLRSCNHPPPFFFQLNGELFYLLVYSIAYID

SEQ ID NO: 26333 - protein, 74 aa, Candida albicans
RNCNGLSELQLQSDNQTSWCQTNLSKTSTLLVYDGFRYFKLFFFLKTLPVVFYCYFQLYTKPVYVFKSCNKNIE

SEQ ID NO: 26334 - protein, 73 aa, Candida albicans
TIFRNQRLLNSFILIYFLVLLEREKETAPNSEFSMTHVRLGSSVDTQLQNSSIKIDQSLVRYTMTFVHELNQL

SEQ ID NO: 26335 - protein, 222 aa, Candida albicans
SFLLLFYLKASFIYLFSICFHFSFFLYSLLQPFETLQSLLLQFFFLVKPICFRMSEFIVDLFPSEISKLYLFTSFSVLCGAVFFSAKVNKTINSVLVFCWACFIKPLIQKKTKGPNKNQQQSLESFYKNQAHIYDNTREFLLKGRQECLRLAISHLPKKKDLIWIDIGGGTGSNIEFMDEISKISENFKAVYLVDLSPSLCEVAKARFESHDLTPRDWKFPR

SEQ ID NO: 26336 - protein, 67 aa, Candida albicans
SIKGDNALVFSIGENIGSGKCKSVVSGIKSEHDTSGFFCTFLILLDGLNDVGFSIFISLYSQIKSLV

SEQ ID NO: 26337 - protein, 74 aa, Candida albicans
ICESRFIGPKNVYSSTCNLKKTSPNQHLTNGQPPNDQSIRATPYHPPSTSIPSISLPMTQNLNPAKPSVWLNHK

SEQ ID NO: 26338 - protein, 63 aa, Candida albicans
LLAGLYKQQKPKPAANPEKHGPAQDTQVYEDQANAKRPTGTNQHAIIMGINLSSGGGNSPLSL

SEQ ID NO: 26339 - protein, 84 aa, Candida albicans
PNTHDLYQGDISLTQTSHKPTKFEDDKKKKKTTATDTHSFTDKTNQCWKKKFTTRHQKQVRFSPTSQMHLFVVLGLFLDTGRLR

SEQ ID NO: 26340 - protein, 69 aa, Candida albicans
NGSHKFIADIGNNGEMYKSRELVTDQLGDFSTDAEFFNRSDANPFRVKDSYLEGHCSLSSLWLSVFFGL

SEQ ID NO: 26341 - protein, 62 aa, Candida albicans
LTVIGSGKFQKLRRIPYVESSQRFLVGLYEEEGSSLYGNTSSLYYQTPRISYPPPDIQQKIL

SEQ ID NO: 26342 - protein, 226 aa, Candida albicans
VIFFFSGYFYTHIIYYYKYSHQFSMGKTAVSSSIQQSNHQQQQQQQQQELCAQLQQLQHQQHQQEQLNRLHQVDQPYQSIQFARLTRPPRIKSPKIKDSTLSTLTQSANDDQKFLFSNLNNNNNNNSTNTYNNPQNTTYTLTSAKETNYPHQPSFSGPSLNNNFAYLNPTNNRNSIFTNLFFQQQQQPQSQQTQVRNNNISPRDLNNKNNTMMHCLHPRGLEGPAI

SEQ ID NO: 26343 - protein, 131 aa, Candida albicans
NRKYVKHTTKHWFQLRLYNKFNAKATKEPKVTVGIVAAKPPDLVLEPEPEPDPDEVEEPEPEPDPDSVEDEPEPESESELSADEEDLEPEPELDESELLPLLVEEPEPEPDLLLVPLVNPEPVVILVILPE

SEQ ID NO: 26344 - protein, 70 aa, Candida albicans
KFQVVEGFSVTVTSLLSKVRHENVLKLPILRFVSSSALYATYARSMLKLPCKQQQCDKPHVAQSKQAPSN

SEQ ID NO: 26345 - protein, 412 aa, Candida albicans
PKKLLKLSFQILNQNLYHTVIMRPTPLFFALLQIALAAKRADQICNDHCSNAYQKQQSCGGTDDVSSQSATLKCLCADESYWSELALCDCSSYDSNVSAQELRAYYCNVGVTGGSQGQSTSGDANAATNSNDATGTATDAAAATNGNDGASGTADANNANNTDGNGATNASNTNNNGSTDTAGSSGNAASETSSGSNNAAAGAAAGTNSASDQANETGSDATNAATGSDASGAAATNTASTASGATSGSGSDTAKKTGTNTDSDSDTATKGSDATAGSMTTAASGLGATNGTSNSTGSHSGSMTSITTGSGFTNGTSSRSGSGSGSSTRSGSNSDSSSSGSGSRSSSSADSSDSDSGSGSSSTESGSGSGSGSSTSSGSGSGSGSSTRSGGFAATIPTVTFGSLVALALNLL

SEQ ID NO: 26346 - protein, 72 aa, Candida albicans
ILQYMLTRIWNRFYSTSATPKANQTKILFFFNMEKRKNEWKRTKIYNNRNLTHKRLDQIRDEMGQTEERTKG

SEQ ID NO: 26347 - protein, 71 aa, Candida albicans
TVYDELVSDFIDLVLCPLDDIHRRYRSCGLVEMNGKLRELFGCNYFFLPENRYGMQTLVTTNNNLFYTPKV

SEQ ID NO: 26348 - protein, 87 aa, Candida albicans
QYNLNQETRAANAIQQKIKSYITKRLIGMTINSKNHYIINIGSFSYTPYGTHDGNLENKQSFLVLTIYHICDTVHLVLLWPKLFSFC

SEQ ID NO: 26349 - protein, 139 aa, Candida albicans
HNQSSSMKFSISLDQFLQYYNEHGKHPELLKSSQFDSNKIIDSLASNINDSSNQLQLPPPQEVNINDLELDVENLPQCMPPANQEEYENYLMMKKIHHDNFLREVNEKGLRLKNQMTDSTQPPFDSSRSSIEFLRMMGK

SEQ ID NO: 26350 - protein, 88 aa, Candida albicans
MSSNGHKTKSIKSETNSSYTVHSLDQQQASICDNLQQAKFELEPVHLQFSLSNKLNKLLVSSNIMYILLANVVYKIDLDNPSQVENYA

SEQ ID NO: 26351 - protein, 105 aa, Candida albicans
NVPSVNPQVMKSSSALSQCNQCQDHTQWLSPDQLQFIGDDYMLRQIQDIELPDNIADFYVINNNNNNNNNIHLQCEKELVPPSPLLVESRPVSQLILYWFLVLAF

SEQ ID NO: 26352 - protein, 86 aa, Candida albicans
NFLFLNIRKTYNLKTSEIINLPHTNNIYISKIKNQKSKTNQKQIKGVKTQTILLNRMKSAHKKTSFSNANYFFAAALEIGMLTIFS

SEQ ID NO: 26353 - protein, 225 aa, Candida albicans
VLRMFRNKKFYFLLIFALYYTKLKLTHLMSNNPVLMKQYVQNIFLKLQIFFNRYSIPHTTNNVFEHNRLFSREGLVSCLEDSVDEIPNHLTTSTSIDLGTSEFYNSSTIDTTHNENPNPSISIEQICSMIDEELEIINEHDLNNRLESRGSFLTISRQMNMLGFPTLPRSQPCAYQSTNQNLWNVKSILPHTTGSALSINSAATPKKKKMIKILKSKKKRVQTAY

SEQ ID NO: 26354 - protein, 73 aa, Candida albicans
ISTRQPSASYKIKLTIQMPGTKSALDKSLQLLYNYSTNFQVSIELIQKLAQQLKLETFIDSLYSTTEAGRNRA

SEQ ID NO: 26355 - protein, 67 aa, Candida albicans
FFIARVKPELKEYSGCCSRIMDTEEDEEQCIFELISIGTMSIKLIINQRTNSPSSNWRLISILSMKD

SEQ ID NO: 26356 - protein, 66 aa, Candida albicans
IFLFGSGSPLLFRKVTTKSYSQEQYRERVVKREREKKKDGVRPEAEEEEESVQLKKIIKYKTIYNN

SEQ ID NO: 26357 - protein, 60 aa, Candida albicans
IFLHKREEKTVFWGNIFDQSLTKLFLNRVYKVDPFENTVKQSTKPSFIAKKSSSTTFSIE

SEQ ID NO: 26358 - protein, 135 aa, Candida albicans
  UNSURE (31),(32): Identity of amino acid sequences at the above locations are unknown.
PLRRPSIDDSEKKLDNTDWIEYIQNENYYFXXRYRDTNIKARDFKFLYNFTINSIRNSTEVLTNKEDNSNLAKLGIYPEYVNQSRGKRPKLTFAALAKFVLAAVRIRQRTRDQAERYRELTRVRGEVDVARLKYN

SEQ ID NO: 26359 - protein, 217 aa, Candida albicans
LFLTMSRDGTFSYIHLDDPNKVLYIERWKDEPITYDDIETSNLVEAAVNVYPQLFAEEEEDDGILNFPSQQFGSKLYKNRRSIKQKRWMDLNIESFKLDNKNVVDKTLVPPVAGEPDLAEFLSNGYNKEELLVLQLSPGNNTVLHNSDMSLNSTSDYVGNSNNTFINMRSNSTSHQQPSQQQQQQQQQQLQFQTPRPGRVRQVSTDKFQTPVSRIMR

SEQ ID NO: 26360 - protein, 84 aa, Candida albicans
TKRIIMSYERIETIDNPFNDGNIIDNDTSTLFVTENNDDDDDNTITTTTTTMQKNNDDNQSSGFQESSNQDVTTVSSSSPSKWP

SEQ ID NO: 26361 - protein, 101 aa, Candida albicans
KILRGIFDEFYATSPTKRVKIRGLRTKRKDKGKRSGEKYKAKYNPLSGGGGTGTGTSSSTTTTGDFIDDQEAFEMRALNEFDFESDNDDDINVSHTRRQML

SEQ ID NO: 26362 - protein, 109 aa, Candida albicans
HEIENVFNCRQYIYSEVIATKYTRNPFSPAYSVRLAFLAFKLDNNNNYNYNYNYNYEPSQVSFPPTTVYINLLVFETIKRENSQPFNNLIIFLNCLGLPPPLLHFLIFR

SEQ ID NO: 26363 - protein, 66 aa, Candida albicans
GVVHHLLKLFCVILGVIPEELLSTTHPTPPPAIIILELKNPNPTQPNKTIKKYGAIHIRASNRHVT

SEQ ID NO: 26364 - protein, 76 aa, Candida albicans
NNNTTITLKTQELAGNKYIAHLISCFKIGVINPTTKLLNQLHDTANDAPFDLTDNGYDSLSNKNGIGPNPKPNDAL

SEQ ID NO: 26365 - protein, 67 aa, Candida albicans
EGTIVDKIPTPIPEKTLPMANIKILGQKACNDPPIININVPNNNVRFRPNLSDNFATIIELIMAPIS

SEQ ID NO: 26366 - protein, 65 aa, Candida albicans
LIVDTLHISSVYYKHGIIFCKREREATLALSNCLWGRFKIIYFSNKVKVKSKQKEAIKSNNNKPS

SEQ ID NO: 26367 - protein, 68 aa, Candida albicans
IYSIITQNSPVIVWRKKKKKRGRGGIPIPKLHKMNNNNKDEKLLKKNLFQFYHYLLINSIPTNNSKYK

SEQ ID NO: 26368 - protein, 83 aa, Candida albicans
KSTLSILVFKLAELKKQKVFLMSLGFIKTKNRGRLGKRVRSILHRVAMFCIVVSVKSVTQALFFFLVGGRPGDNNRLGERGSM

SEQ ID NO: 26369 - protein, 250 aa, Candida albicans
VMPIELILSPLMRPAVHAKSILFAPHRNASHYVPRIKELPPPETISQYAVIRRIGTGSKVFDVFDTQRGKYPTGPQDPNERIFWFKRSRAAKGGYTMFSQDILHTGPNGEDEPIANVRAGLRGNVLLIRASQAPAAELGWHIINHRVDAIDTYRMFTLCDGNTYQWTYRGQWLEKVSNVGEKESEVRERIGRVVPNGDFGFTLFIDESKMVREMALSTALCSYIDQWNTNLEVGGIYYGRQKGQVRWKRD

SEQ ID NO: 26370 - protein, 66 aa, Candida albicans
SFTVYMEMSFHFGEKTKTKNKLAQDDESVCILRPIQTVPVMRHRFSCTICAIARITDNYGPVRFSM

SEQ ID NO: 26371 - protein, 98 aa, Candida albicans
KGVEVCEFGHDGSDWENPWLVSFQNIDHVELIAASNASWGSNEEEEGRDPRLRNFVVDIVNAKVVYDINESSNNIKRRNCCILFYFILCLTKNCIKGV

SEQ ID NO: 26372 - protein, 61 aa, Candida albicans
RNLFVDNIFAKITFVEHEIGNTVHIFYQSMKVKLQKKTAKPYFALFMNVFESAIYIYIIAI

SEQ ID NO: 26373 - protein, 70 aa, Candida albicans
  UNSURE (63): Identity of amino acid sequences at the above locations are unknown.
TQKWIRQHITTKDKTNQQQVCLNRYVSSHALVLVVVCVCAFKNQRNFRIPFYHHYHHSKKICXHHAWKST

SEQ ID NO: 26374 - protein, 68 aa, Candida albicans
SEGETTERERQKRMFRVVAAKETKRGKKIFYLSLQTNNKQNKIKRNSPAKGESSVQFLFLLLHKIVIR

SEQ ID NO: 26375 - protein, 89 aa, Candida albicans
STLFFSCTTTIVYKLDEFRTNTIAVKTQHKIDIYTHTHYKLFQTISPIPYRFSYLHFAYFVFLDILTLLCISFCLLLSGLVIGCCCCII

SEQ ID NO: 26376 - protein, 79 aa, Candida albicans
LLLSPSSVLPAAHLHFLQTAATTTATPISFSPATTTTTAIACFLMYDLNLPLLLFNKIFQFCFLILTFFIISAHHFITN

SEQ ID NO: 26377 - protein, 70 aa, Candida albicans
  UNSURE (7),(8): Identity of amino acid sequences at the above locations are unknown.
KYIWIFXXNNLRKYYKWYVEKLNYPLLKHLFLSGKPMSYSNKNLGFFLAEWKIFKNIRSKKNKKFLGYLS

SEQ ID NO: 26378 - protein, 70 aa, Candida albicans
RITFLSFIRTNCHCRERIVDVNDGKTTMLNKFFRFEGEGFMTCLYSWISKITKFQSTICNNEKIPHNQKC

SEQ ID NO: 26379 - protein, 68 aa, Candida albicans
PRDYLIWLNNSAPPPRRRRRSLLIKEIDFSSICSSYCLVNSHFQRMEKKMVKKKLISHPSNVVLLYKP

SEQ ID NO: 26380 - protein, 65 aa, Candida albicans
YIINTPGLNQAIVETRHFTKINNKLPRKSAPILCSHIYSSKYFLHPKFFQIFLSKSFVTFLQILL

SEQ ID NO: 26381 - protein, 82 aa, Candida albicans
ENKVESFIYFEKRTWENFFLLKRMVKRKQYFWIGERKTNFLQENIYYFSLKKFSDILNIETTTTDNHNNWSIVKDLILYMFR

SEQ ID NO: 26382 - protein, 111 aa, Candida albicans
QINKKYNMSTMPPTSKRTRKRTRTDDNAEPTIQDPSPPLANVEPTIQETPPLVEVSDETNSTEINETNSNTHEETNVLTNVHSSPIETVTERNFNFQQVIASISTGTIKIS

SEQ ID NO: 26383 - protein, 75 aa, Candida albicans
QMRKSLKQENQQDSKSNLPKKSTANNEYTTVEKLAEVVTKLESRVSELTNAGLEKDKKLEALEKKLEELLKRSTA

SEQ ID NO: 26384 - protein, 60 aa, Candida albicans
FFLVGETPLLELVDLNDETVAEGDSNLVLNSDVAEPFEMEVGVSGLLGVMFKALAKASKS

SEQ ID NO: 26385 - protein, 979 aa, Candida albicans
AAMGTVESLVKLRTLTKKYCEDDTQVNFNELYNHVFSDGPSIQYLDVLLDCKVLDKTILLIVEGKYLDTLKFYKFSLRLLVHEYFRRNGNKRKVKDVFFFQLNNKLRWKFVDKLANFVIDKSIKDYEIKIDILRLFSILQLSEEFGRYIFVHCIYDTDIQLNYSLEDIDDNLSEDVKEKRKNQHWLLQLINSFGIKTDVSLTNWQCAIVRFLLSWCSSRKYGEYIQLFLKAVGAPSYFAIYASQGTIELVNLLKHVLEINYCSVTFSQFRQALRLMFKDHTQLINKVVSYTSLYDSSFESFSVLLNQYLTVSEAKELLDRFIPTEKQANFGSLKQLTDANDKKQFYIDLILTQVYQSSTFKHRFWKFVTEKSFDDIPQDMKFVTHYPTFERFVKAMSFEIKDDGLREIHDHLKVVMGRIKPKNALSYTGTSKYFTKIESLVTLLPQEYEITVDERFEGDEFKFAAAVTICKPVKGENLKKLGIGLVRVGRITKQNRTFIFKCENLEGSNVTHLVFLPNTAILKALKVLSYNNEMIYVQNITNTLLVTKCLFDNNMGDSTEDSNKPLSVSQIFSVKKYGDISMVLPDVTDFHTIVLTPSKTFLQQYKDVLLIRYGDAQSVDAVLRYASEYFEKIQTVLGNGDVLELKKISLPLQLDRILDNCLNKWDNIILTNGNELPSEYLKIVRNPISNSSDAARETTFLKQTIRVIKKAWFLFGKDLNMTVWNYICNSFSVVMTVDDWIKVFDKIQVDTSFVYINCDVLVLLMSYFKVDWQKQRSGSIKIIGGGLEDLFSFKTPEEITHKIQSNLNIPTFNPGLGCTKQLISAQNQLEEAELCVLLYRYMRALGYPRESIGIWVSCKRQLDLINEIAKESDLDKDVGLPIVLFNKSGIHDYDHVSYSIVSLFTDSGYKELDCPGTLGNYYFSSNIEVDKELLDLSDSTTDYRLKIVEGEKFGLKERTNESTVAVQSKVQFQKLIDRL

SEQ ID NO: 26386 - protein, 103 aa, Candida albicans
PFYCSWSTGINSSSEKFFFVNCVRSREFQSKKMTPTSPIRRNNANATKIYISSIHIKNFLIYKPKDRKNKSRRNVFGGLLISFINDLLTFEIGLYFVQQRYFH

SEQ ID NO: 26387 - protein, 65 aa, Candida albicans
  UNSURE (63): Identity of amino acid sequences at the above locations are unknown.
AMDNINYTNLKRISADIKQITIELKTLEAQKSIHRKKSEKTKQNGNGNGNKRMAVCRVNIVCXKW

SEQ ID NO: 26388 - protein, 139 aa, Candida albicans
  UNSURE (125),(126),(134),(135): Identity of amino acid sequences at the above locations are unknown.
SNFTTMAHPGRPRGRMNKKTLQAQAELARAQQAQAQAQMQAQRAAAAGQLAPGGNGGGIPPPNGQSQHSAKEETLGVQLHDEADLISFRNDALFRYITNHEYIENVTSKLIHTSKIIPPSSYCSXXEETVSDQXXGNPP

SEQ ID NO: 26389 - protein, 60 aa, Candida albicans
VYLLDMLLMFSRLHGVKLNCFLDSSQFLLHHRHWARKLSTNLKDPIEYIQLSAHIFLFLY

SEQ ID NO: 26390 - protein, 99 aa, Candida albicans
NNQNPFYSVLLVCRHFFSRFNSTNVKSTERRRERKKTFQHLLYETPTYSITQIPTMNVFRGLISIPRISCVSQIYSARQLSSTLPVSTSSLGTAGSPLI

SEQ ID NO: 26391 - protein, 72 aa, Candida albicans
PQGSHRIYTTISSYISISILINYTYINLIKTKKNGLEKKKNLSPMCGEKEETTNENNIYIETVKIKIKIKIR

SEQ ID NO: 26392 - protein, 88 aa, Candida albicans
VKSIVNTSIKLPEVPYCLKFDFTFLSLPLPLSILTSISDPIGYPPKCAAATRNEPVPVNGSYVILPGAICARLQVTNDSSASKDVVPM

SEQ ID NO: 26393 - protein, 64 aa, Candida albicans
DWRYLGVFILLLRTEEQQLHKFTRSPHGIPQICGGCARLLFLVEPHHPPHPFITTTQIGQAESL

SEQ ID NO: 26394 - protein, 63 aa, Candida albicans
CFFFSLFSFVVVARKKKVSSQVLDSIFTPPQTQFQLTINNPIWVNSIYLQSVHLRLISWIFLV

SEQ ID NO: 26395 - protein, 215 aa, Candida albicans
VTMKSGLLLAVILPVAFAVKKDQQSCNSSCVKVLQKQQESCPSGSDADCLCKLSDSDYWEPLTDCDCINPDKKLSASEIKVQICGAPSSSSTPTSSTETTSSTEAETTEAETTEQPSSSTSSNTESSKTTILETPSIQELNAESTTSVITPLTESAVAAVANTDTSTLIEPQNTEATPEVAPLIQPQLNNGSDLAQVSVQAFEILPTRGEETAWD

SEQ ID NO: 26396 - protein, 74 aa, Candida albicans
GGEKESNTVFEKIKNGNHKNNWPKSVIYFFLHKQNDNLKAQRYFKVQNVSMDNVEFFSFSNRYRFQSIQFYGCD

SEQ ID NO: 26397 - protein, 311 aa, Candida albicans
NFISIHRNMSDLEYDRDVAMEEPQPYPQYQRPPPPRKIDFIGLDLPDIADPMYKSKPEQDLDVRYEVKEENEFHETRALFIGNLRRPINAAHFQLYLRDLAREEGSFIIERAWLSRARTHAIVLVSSEHGAVYIRSKLLNTVYPPKEEEKRLRLEFEEKEIERFEEQKRLYEQELGRLNEKEREALPPPLEPREYVTERIPLYVEYIPVKAINQWTFEEDRGPRDGKWKLEFEHRDGDTVASHTLLNSDYIPRYVPTRRGPPRRYNDRPYNAPPRRADSYVPNGTNRRTDTYIPSRDRNRSRSPSRSPRRY

SEQ ID NO: 26398 - protein, 96 aa, Candida albicans
PLKPMSPAFQKISFLGKRGHGFFRNSSFHQLRIGRGRMVGTKKGFWFSRGEVFACGNPWLKKSKKDEVTHATINDSPPLKRKGEEEDCIVPKKGKS

SEQ ID NO: 26399 - protein, 67 aa, Candida albicans
LSLLFDISFRLVDKVQGVEIQNGERKKVNIMRRGLEFLREKKKIIKVCFRDPSNREHWKGAKQKTFS

SEQ ID NO: 26400 - protein, 61 aa, Candida albicans
KGDLHQFIVERVLKNPIFDSGLSETNFLLIVAQFAELDVRLVAPGTPQLEINPANNCLAIK

SEQ ID NO: 26401 - protein, 124 aa, Candida albicans
  UNSURE (79): Identity of amino acid sequences at the above locations are unknown.
GGGEQQNDDENNDIANAYFPDGDERNLINSILDEKIEAKPTLWRKVLDVIWPNYILNHLDYASFKIVCRSWCHVWSCAXLKIIPTTYYWLGNAAYLIVVLGFFSISGGSSIIMNFWVIVGDFSG

SEQ ID NO: 26402 - protein, 61 aa, Candida albicans
TFLTKKTNKVLPILFFQYPEKLIQPRYESNAGIMNQIGTRKNKQLRESVSNRHYADFIVSF

SEQ ID NO: 26403 - protein, 76 aa, Candida albicans
KYFFLSCSSSFSITNTHTLFLISIIKSRRMWCLSKPVIKKKSNSESEPTTKIQQKKNLYENKCMVCKKIFVCVVCI

SEQ ID NO: 26404 - protein, 69 aa, Candida albicans
IQTLIISSICYESNNTNWKSSRSNLSSKKSTNLKKKWEVDEWVKFIEIINSSTDITSKKKKYGSPNFDE

SEQ ID NO: 26405 - protein, 74 aa, Candida albicans
  UNSURE (29): Identity of amino acid sequences at the above locations are unknown.
ILSSEKSCVNRFEKYKTIHVNEMCVKVQXTTKKNAQNMLSAPKKKRTTNPSFKTISNLVVTITINCSPLEPTSN

SEQ ID NO: 26406 - protein, 110 aa, Candida albicans
FCEVFLEVDDTGNWEISPPFPSVEDIKLATGLAGVVDKSRFRNFLGDVIEGVPEATGEENGLGGLVCPEVENSCFKLGLSLLLIGINSFWIICGDSTGEIIGVINGESKG

SEQ ID NO: 26407 - protein, 70 aa, Candida albicans
PILCNLLLWKNPLSFSSSPFTRFRILIKKKHGFNIFVEKEKEKEKEKEKEKDSFRMKSTQHSFNHISLDL

SEQ ID NO: 26408 - protein, 105 aa, Candida albicans
LNECCVDFIRKESFSFSFSFSFSFSFSTNILNPCFFFINIRKRVKGEEENDRGFFHNNKLHKIGYTLVVQLMKKIIVGSSCPPPSMLTTTTTTTTKTTTIIRNTH

SEQ ID NO: 26409 - protein, 98 aa, Candida albicans
SVLNIIRRHIYIISNHNNSPLYSSITHIQSLAYPRINTLKAANIMAHNDQLTLVNTPLLTFIDSVSLVVPSVVKLILIASALVVSLPSQQYFSKHFLH

SEQ ID NO: 26410 - protein, 104 aa, Candida albicans
WEEEDLFGFLYFFLSLFPITREREKRERMKKNNNDDNFILCWGGGAYTSSSSSQLLFYSTKYFFFLFSFGPTFATNPHRPTTTTTTIPSHPTNSNQATSFEGHV

SEQ ID NO: 26411 - protein, 76 aa, Candida albicans
FICKFLFVKARSVCVCMYRVEVLISAEKKKKRKTKESGNHDHHHHHDVISRRKRIIPLHLYLHQQISIDVISTNLN

SEQ ID NO: 26412 - protein, 209 aa, Candida albicans
IHTVLSFLPPPHFSSLYFKHTMTIQSSISSSNQSITPKTKLTNLELELELELEEEEGEEQPQEVQEINSTSFSSSITFGLYDESDGDKAYLAKSKLIAESIQSIGFGKYQIGLFFVAGFGWLSDNAWPVATSLILPRLNEINGVHPPPPSSSSSSSSSPNKGPYLMLAQNLGLLLGAAFWSISSDIIGRKWALTLTVLTHKDVKIRALM

SEQ ID NO: 26413 - protein, 62 aa, Candida albicans
STRIHVTIITSLFIFFRTTVNFFRPVLTFPTRPDYITNYTKKLGITSITRSPPCSTKKYRNH

SEQ ID NO: 26414 - protein, 250 aa, Candida albicans
IKEIMYSEAHRLLLTYIRSVRYVEAGVLLEAFKFMLGNLQLEVQPLKNVLDQYIAEINSKISGQNFKIERKTHEITGDLYYIFINTLSDEIVQESSVYTTAELTVIKYLIRNIIEASDYRCSLARVNANQTISTNTNKNLMEADSMVDRLIDDGWFISTIDDRLMLSIKTLCELKEYLIETYGVNGDDTDADGKVLLCTQCKEIVTLGWIIPSGSKPFHRKCYDVYCRTNQIYPEDESDLLRVGPDPSTL

SEQ ID NO: 26415 - protein, 66 aa, Candida albicans
YKKIPQPLKTKSSYILKKKNFNSTIKKHFYSNNTTITKISAITTLLKDVANILETPDLNLEFSFPG

SEQ ID NO: 26416 - protein, 197 aa, Candida albicans
RKRKKKKIENDIKDNVKFIEHGNILRDQIPIKYKNALYYEQYEYTTTKTMEHLLNPVTVFGEKAIIEMDDKRKNIPVIPNSKIRLFKNGVEQEPITDLYSFLPTNIEDHEDINLGPNTKQQQNPNYRNTDDGTLGYYPMLSAFQFGVVNLNAGPNFEFPPLDPVKPLSDRYNEQVVEQYYWDLVDEVEAEYLDSFDL

SEQ ID NO: 26417 - protein, 70 aa, Candida albicans
MNNMYLKKKVRYPEVGISNPYLYITKISFPSSKGLYNWCLIYLTKNIFPDMKKKKKETIANVPFWETKRV

SEQ ID NO: 26418 - protein, 60 aa, Candida albicans
IFMVIIYFMEQVLGEREVGLFIGGHTSDLFSQISLLFLEVIFKSPCLFVWFFFFSTHGTI

SEQ ID NO: 26419 - protein, 115 aa, Candida albicans
SSWLLLEIVDCYCCCYHHGPNNVLQPRTHVYATISNDILFLFLIIINHTLSGGTDMPKKKAPFAIHHNLMKFHYQKNTNNNHRGFELEWKQVTFILVHLFKNTLADTMCVCVCQN

SEQ ID NO: 26420 - protein, 61 aa, Candida albicans
DWLFVKVKFTSTYSKLSFQDPNYNQSQISYVLAKNGARKCAFPRKSYKPFCCLGYCVNRLL

SEQ ID NO: 26421 - protein, 62 aa, Candida albicans
MAHMIVFKQQQFSNMVCILFILVIKRGQCHKIRILEPFPKFPLINYPLQGKEKTMTALTKNI

SEQ ID NO: 26422 - protein, 70 aa, Candida albicans
QTQGRVDLEKPNHQKLDGPDKYHDQDRPATNVYGTEKPLPTIPGFAENIAGKVNGVTGNQPTTRGSVSCK

SEQ ID NO: 26423 - protein, 64 aa, Candida albicans
RTTHSLNKELLKRFPNRTCVAEVSLCPVNFNCGEVPVTQKYVYDEELLAALDDPFLVKLQSIIG

SEQ ID NO: 26424 - protein, 102 aa, Candida albicans
KNCTGSLTSLENPLQIRVPPVPKNQSQQLVNPRLAILHFAQPVLYQHRRVYRRKPKKRKPDIQGNTIALRQLRPKQVYTFWDDVQEIQSHEKLHSLLLRLVM

SEQ ID NO: 26425 - protein, 74 aa, Candida albicans
LFMWQKFRGQDIKVARHGVKHTKWAAITTNARTKFCIEKNIHFFFFFLQPTSPLCCLTTLLITATSSGHRPADK

SEQ ID NO: 26426 - protein, 85 aa, Candida albicans
LWRSPSHPKICLRRRITRCFGRPVLGKVAVDYRLKNQVIMENYMFAWYLNFQGIARNLFTNILKELHWVIDKFGKSTSNPSTTSS

SEQ ID NO: 26427 - protein, 72 aa, Candida albicans
FSLISGNTIISTVRLCETQVGLEVYRRAQIYMYIQWFSLIKTVGIGGVLPSALASAASPRLNTIGLSEWCFK

SEQ ID NO: 26428 - protein, 71 aa, Candida albicans
MRILVWNIVETKYQHDISLYSNLKHHRGGRVYFLPCYTHPLFEYIQDKYISTLSIHEKRKIGTTRQFCLYF

SEQ ID NO: 26429 - protein, 93 aa, Candida albicans
PTHTYLGIIYNWKIPLPKVLHETTFDFYLSENQTNSISVNLVDKFRWGKNRIYKFLWILFLMTGYIHRLFVNTIQNGFGSIIFDLYFKIGFYI

SEQ ID NO: 26430 - protein, 66 aa, Candida albicans
FNYSISKITYIKSINKIRITTKHDPVYSKIKKKANYPVHDSKYLWSVFGACLRSSVSGINSSKPFS

SEQ ID NO: 26431 - protein, 65 aa, Candida albicans
CNPEVFTETEMTLYQAVRARVLYFESFAIQALGGRVFSKYVAEFQILYPFIVKEIKVVTPFSCRD

SEQ ID NO: 26432 - protein, 63 aa, Candida albicans
TTIMSDGSFNGHPFTIVRRDVVFGVALYTIGYLGGGYETLPALTLKFHAPQAIKKFKERSKNK

SEQ ID NO: 26433 - protein, 71 aa, Candida albicans
KIHELDTSKPVMMPDGSIGVAYFTIIEHHYKRRIMYFTIEFENGNTKTLLETTIMQYEPKAIFKYFGRFLE

SEQ ID NO: 26434 - protein, 61 aa, Candida albicans
RLKCNHKIYLSNLPFPTLLIKVLKSTQELYILHITCPTQCIKHNQNVTTRDRFKNRITNWY

SEQ ID NO: 26435 - protein, 63 aa, Candida albicans
LQTTMPQEYFNGSEFRILFRDVIKGKVFYEIRYENGLLELIPETELRKQAPNTLHKYLLSCTG

SEQ ID NO: 26436 - protein, 66 aa, Candida albicans
PTLFIMPDGYWRGLSFTIMSRQHINGKSYYTVFYENGEYESLLKETLENVYPKAVARFNEKWDGAK

SEQ ID NO: 26437 - protein, 63 aa, Candida albicans
QSYFQLAQDTTKCPIPAPNFLASPTIPTCVLNVITNIHKSILNLISLTNIHFYLLYKIFPSRK

SEQ ID NO: 26438 - protein, 62 aa, Candida albicans
RNIFFSLCFSIHDNCIFRLCILGNKLVLFGLTFIQIEDCRLDDLARQANYFRYLISTNFLLF

SEQ ID NO: 26439 - protein, 156 aa, Candida albicans
IYILLLLLHYINYCGYLNGLFLLQKNSLPYKPVLNKANPPSPSGVILPLNMPRMDSLPLTIRYNASHAKLNPLAFTGSPSYIIHAPKSDAPPNVKQDNRVGRARATLRPNLNALPVPPVAPTFTGVALVPNNPLRTRDPPNAAAGIGDTDNLSIES

SEQ ID NO: 26440 - protein, 68 aa, Candida albicans
MIWQGKQIIFGILFPPIFYYFDFIGQIKWSFIEVHYQISNIIPIYIKSTPGFFCTIKQELKPKIKKYQ

SEQ ID NO: 26441 - protein, 141 aa, Candida albicans
  UNSURE (71),(78),(84),(89),(95),(97),(99),(126): Identity of amino acid sequences at the above locations are unknown.
YNPPYTMAKQFKRKSNGVSESNRKRGRQELRKVTRTAARKQQQDENHEDDLNVNNESEEEYSGKEIDEEDXESERDDXRGKAYXALLTXIKSEHXEXPXNVTFGSSSQVEKSQCILILKMTALVVXWLTKKKRVKWILMWM

SEQ ID NO: 26442 - protein, 73 aa, Candida albicans
MDEKEWNRSNNPGLGGSEDSIYTFEPEVIALLGDTEEKAKKIKRFSYFFFSFYSLNEFRGVCVIKLSKCLVWF

SEQ ID NO: 26443 - protein, 83 aa, Candida albicans
NLGDPCILDHKRFQFNRMIPLTITPHYLQISENIIHLCEQQREFTPETLDAIYYFSERVRTKMFRDLAVQILVSSITHTNKSP

SEQ ID NO: 26444 - protein, 63 aa, Candida albicans
TFGELCYDMLKGQYQKTERINFKVAYRLKGISSLVTSISLSLPLIQDYNFLKPLSINKQLIHQ

SEQ ID NO: 26445 - protein, 67 aa, Candida albicans
NFESINRKREKGIILKIEDEEVRSKKQEEGGGVCVQLVDKEIIKLLCNNTKAKKYLVTQHLSTHYKN

SEQ ID NO: 26446 - protein, 286 aa, Candida albicans
FIISIIISILIPSRSYYNLSFTAFFAYTFLNLYKSFFKKIITIIYTTTPSPPILSFIMSDAVEKVKQAVKPQQHFKSITIEHVYHYSFIEYITQYLLSFQIVNSIYKSFVLPLIDFVNVNIFSVSPIFDLLSFVDQLINSGLVTFDKYILEIPVQTINSFGKTYVTPVENKLINLNNKYLNTAIEVKTRSEGEFYKVVETVQQVLINLKNFTFNKSIEIQQDLVATYNKELQSTDPQGNLIGKNLQASYNTASKTINKLNDDYLTPLKNQTQDYVDQFATQIKQRA

SEQ ID NO: 26447 - protein, 64 aa, Candida albicans
FTKSSTPTILTDFKNIKKKKSKLRVKHILHVYIYIEKDIKDKICDRLPKKYSTQIYVYKTNNIT

SEQ ID NO: 26448 - protein, 81 aa, Candida albicans
SIPYVTNLRPGFSHFVLAPEHRTCAKRSIRAGNGQIRKEKLGTHSPLHKFPKEEEQPVCGENFIRIGLFHIKGYLKSKFVS

SEQ ID NO: 26449 - protein, 61 aa, Candida albicans
ARIRPLRGEDMRNAVEDFDELRRSNNEKYDDLKLFKLDCLRSSDMSIIVLPHATWDYIDNE

SEQ ID NO: 26450 - protein, 74 aa, Candida albicans
NFNKFGGRICKRPKRRRELMKIFRIGGDIQLILYSFFLKYEKFKRCGREIEQFLNEEWAAKTKRNCVCVRVGVY

SEQ ID NO: 26451 - protein, 76 aa, Candida albicans
CRKVLLRNRWVQGRKIIHFYFLWCLTIHIWDTICWKVCAMAINIYSKEDGQGQFYAIPTVKNFSLMPARPEKPEQL

SEQ ID NO: 26452 - protein, 63 aa, Candida albicans
IRIYLLSKMMNLKAGYMIIWKALFIWILFTSLGEEGYTENATDMVVLTNNPASIELYFLFLPY

SEQ ID NO: 26453 - protein, 60 aa, Candida albicans
IYLLVVKVILSLQEINDPINPWDDVFLGKVIPGGAQSVELRPDVHTKMLKLETKTSPFIP

SEQ ID NO: 26454 - protein, 219 aa, Candida albicans
STTSCTMSSPTNRLNIRKRKKVYSNESNLSRQQQQQEFLPLELTNTSLEQKPTQPLEDDKLINYINKMHPRVDVSQPDKVTYITILLTLSEPQRILEQKQKLIDNFKIGDILVTNPVPGSIDQYLTIYGKPTCITKCLMYVIYYLNVIMHINYDLFTFKTANYKFTILLNSQNLKFKHNLKYLDIAQYSESIYSGFIQGELHSNFKFVPQTTEQGNNVQ

SEQ ID NO: 26455 - protein, 316 aa, Candida albicans
LQQETIVTSKTTSATTPGSSSVESTPGSSSATTPGSSSATTPGSSSATTPGSSSATTPGLSSVESTPGSSSATTPGSSSATTPGSSSATTPGSSSATTPGTSSVESTPGSSSATTPGSSTIESTSGSSSATTPGSSSATTPGSSSATTPGTSSVESTPGSSSATTPGSSTIESTSGSSSATTPGSNSATTPGTSSVESTPGTSTGSCWISVSTGGYGYETTVTICSDVTSGQSVTTPTTISVPTTFCTTVPTAGTDETVITSYVNSTAHSTEVITVTSCADNGCQTHTTHTGVVVVTVTTTDVATTYTNLLSIDYN

SEQ ID NO: 26456 - protein, 96 aa, Candida albicans
LPLMLLQHTQTYCPLTTTKAVYRVAKLANYKRDQTEFIATETNEDTSNWPAPTLVPYVGISNDSSAAVSTFEGAANSVVPRLGLIAGFLSALLFLF

SEQ ID NO: 26457 - protein, 442 aa, Candida albicans
ELLLHYQQSTNKFTFAMKLESIAVFAGIVSTALAGVYHKPPPATTYWTTIYAPSTSVVTVTSCSKGGCGTQSYATGVTKTKTVHEGVTTEYTTYCPLTTSHEVVKSTCSDTLVVWSTRSFSWVWSFSKPDGCGQSTSTIKTTAQTDVPTTATATPSVSTTCTTGTKTKWWWVIKTTDCSVYTVSSTSSSLISTSQVTSSSSIASTTATAPATPSVSTTCTTGTKTKWWWVIKTTDCSVYTVSSTSSSLISTSKATSSSSIASTTATAPATPSVSTTCTTGTKTKWWWVIKTTDCSVYTVSSTLSSLISTSKATSSSSVASSTGSTPATTPGSSIESTPATTPGSSTESTPATATGSSTKSTPATTPGSSVTTGKTSTDWITSFTTHTAHTTTVITVTDCDHHSCTSNVVTTGVTVVTVTTTGTVTEYTTYCPLTSTGNYCDK

SEQ ID NO: 26458 - protein, 79 aa, Candida albicans
LCSMQESFIFHISLYSYLFIYVIVDVLSVFIDVQEYLTVTDKAKGVVVIHNGDGIYNKMFFFYPNYFPPSACFYLRNLL

SEQ ID NO: 26459 - protein, 76 aa, Candida albicans
REHLLFFLLINETAKKKIYRYVSVHTRPRCIYTCKTTLNFFFFFLKIENHLFSSGVSRHQDVYGKINTSSSSLNFA

SEQ ID NO: 26460 - protein, 61 aa, Candida albicans
QCSHDYKPTTLSTKLSKSDITLKDLQFQYNTRAGSNFNHFNMRQEHHGYLFNYPRLQGFTK

SEQ ID NO: 26461 - protein, 91 aa, Candida albicans
NSRHHCTTLGRTASGQLHFAFHMALFANIYLISKSESEVKKRQSTNTTNKHKPRKKKLWHIYNFSGLSLDIFLANLLGFHKSQYEPRKSVI

SEQ ID NO: 26462 - protein, 69 aa, Candida albicans
NCAPNQPMWELPEEIHLEKEQIPQQPQQQQNVIDDLFGTSHNHDDFFSNHNQDGLNSAEIETEENVEVP

SEQ ID NO: 26463 - protein, 65 aa, Candida albicans
LLYSCALKLQLTRCWYKDLVIKETLVQTCLDNISNSTKVLFCNTFSSNYELNVQLANNPFILFSN

SEQ ID NO: 26464 - protein, 89 aa, Candida albicans
SQELSLPVTSEEPVANDSNDLFGGDDQSSSNPQIHFFSHIQQPDQLESPIMETNEKLETVHQTNRCGNYQKKYILKKSRFRSNHNNNKM

SEQ ID NO: 26465 - protein, 302 aa, Candida albicans
VINQYIEFLENDGKKDTSGLAPILRSVSLFGKRANDSTLELGKNSKIPINSATRITIIKGYMCMLRCQYVEAENYFTQSLNDIPNEHHLQLSLLKCYNQMRETGIFKKKELELMLHNVQKLELDGSLKQQILAKIYHDLHNIEGNFKSKKSGKKKNGILRLNQWNDYLKLLVETYIQAIIMAPVDDLFIPLLYDQILFLLIVNKINIRVIAFFYQIRYHFAIRADYEYLYIPGVLDDFDPTSVGGEIIYDIKQYLEKGIINGATVLKEDHADYVKYWMKEYRKEHKVTQAIKYYYDKVFMET

SEQ ID NO: 26466 - protein, 66 aa, Candida albicans
IGDQDYLHICAWVETHQIKLTLETTQSKISCITVSLTVHPLQTITTTTTATTATTNQTMFKKLIHR

SEQ ID NO: 26467 - protein, 183 aa, Candida albicans
  UNSURE (133): Identity of amino acid sequences at the above locations are unknown.
YLLVTQFHYQEIHQRKPLNINLSILNQCYKEYKQNPLKKFQEEILKEVLGQHHQHQQEVIHITYYKMPHNIININNNIFLKNELMKYHHKFSKLKIYLIYHIKLKNYHLLIEVRLVDAVSDDESDMIIPMEAXTSHYTGGGGHGHGVDNNIYRNQSTKSKQSVLGTRANYRRFVSNVDNDYEY

SEQ ID NO: 26468 - protein, 67 aa, Candida albicans
FLFSLFKHPQLFLDKRNVAANVHANSNIEACTVNISLCTWPTNHYDDCIHHSNTLTLYYTLTIRSQY

SEQ ID NO: 26469 - protein, 77 aa, Candida albicans
VALFLRAARGEDDQEIGTNDEEDNDEKFLITCNIYDLDLKSKMKYKHWLKVENDLQEIYNSSNPNWRYCIKYDQIHH

SEQ ID NO: 26470 - protein, 129 aa, Candida albicans
TVRTAQLFHHSPIMTDLTKQPLKGYDNLSTPTLFNDRNLHPTAKSFTTNILIVGGAYSGLSALRSLQLHLAEQIQRFKQEQPSTPIKKLSLTIVEPRNGLLNILGIPKSIVDSAFAKTQFISFKDLNNC

SEQ ID NO: 26471 - protein, 62 aa, Candida albicans
CHLMTDVNNFNRIYREENLENKIQVYNINAIKNASLYTKISNKRTNKQTNEQTNKQTKCQIY

SEQ ID NO: 26472 - protein, 88 aa, Candida albicans
PLHKFSSKFYYEVEYNYYSKLTKYIISCLLDILIVHRLTSIHFFNFPSVFKTFFTVLNIVLLFVYAGNYMRQNLHLRSKPKKIKCWNC

SEQ ID NO: 26473 - protein, 62 aa, Candida albicans
EKWRQKFPLVLQLEEFCKKNANRNIRILISIILFSNNLAIIKLYTYIFKYKMFIQLKKNLPI

SEQ ID NO: 26474 - protein, 524 aa, Candida albicans
FHFGSPINWPLIYSSKTPRVNTGDTYVALLFVLSGSCVSMWMLSLLLYLSPKYKRKPLLTQLATVFYAIITTFFLNKLTRASEKQYYEDVLDIVELHTILYNNVEYRVLIIIFQVLLLLSWFQIIQKLAKQKYKRIIAIVTGVLMAAFSGCFIYYQVEYNTEGRIHMENISGLYLRWKVVRSVMKLILVLWFAGNLLYYTTVVKNPRKICYCKKLLPLAIFNWFLLILHIILGILHISLFEDNWLVRTWMVLIPYLIEAILITTVWEWIFNIWVIEKRIELMGVLGRRISIDDVLSIQLLRGNNTRKGEKTFTKNGSSSDSGGFHGRSGTRKPMAKFQNWIMNRPKRVTTESEILSNNDINELKEFSTFSNSSSNNDPSQRNSNSQLQNQTQQVNTMQRNNDQILQQHNNLHLQNLDTDSAASSSQLQALALHTEDDDVEYDDEYVDDYEIWDDDEDEEEEEEISHHQRVSSTHLVGSTVEENDMHLGSSNNRHGSGDHMDLPPAFQPHPGFEAGDYWNDRKEG

SEQ ID NO: 26475 - protein, 61 aa, Candida albicans
VIQNHNNNNNKNTTTNFTNKYLEFSQSCSHVPAQSLVLSVIVTFSVFFFKLYCIFFFCLSL

SEQ ID NO: 26476 - protein, 105 aa, Candida albicans
SFFFVQKTFVAIVAKYHLTKVVGDVDYGKIENEIYNYDSVFMFSLTKPNLKLIKEINLKLLKEKNEVKEKKGQTEDYLYIYTAKVIPVTTLNFINSNKKKKYNTI

SEQ ID NO: 26477 - protein, 80 aa, Candida albicans
PFRHAGFSTVLAYFNKYIPCNLGKRYRAKILKMCTNLNYNVYKAVFLNSLDVFIVFEILKSKLFEVLIACHWLDFSSEIE

SEQ ID NO: 26478 - protein, 71 aa, Candida albicans
ITSISSIYLCQDIFFFDSVGYSSFTLEHSTTMSYHITDKIELDLCYHRKILTPQAQLITKFQCTKLHVHFH

SEQ ID NO: 26479 - protein, 69 aa, Candida albicans
CEDDEYEPFLEVVGIEFESFRCGIELEPEPLFLKSRRDSPGTVLDDICVFEFRLVDDVVGDVDDVKFDE

SEQ ID NO: 26480 - protein, 81 aa, Candida albicans
KFSPLGYNLFPKMAKNVVASKKMTKNPHTKLKMTKNVAPPKKDGKKKSHPQERWQKYVASPKKSRIVKKKMAKKCRKIGQK

SEQ ID NO: 26481 - protein, 67 aa, Candida albicans
LGTLLSFLKYSEFEQHLEPKLQLSQINQSLIKQHPTRFKHPYGQSTIESIRTLNTSAHPIHSHTHPD

SEQ ID NO: 26482 - protein, 100 aa, Candida albicans
RQVKRNLSIKFHPEGSLSEIVLNFPKIFWISLDVAPAKTNQGGATGLIYGSLTANKSELYVLSTPNSKIPQDQANTINCLTNLNNSKTPPCCNHHNKSTI

SEQ ID NO: 26483 - protein, 79 aa, Candida albicans
ISAIKNVEIVFLIDTKVCNFCNESKFQFFRESARTITTEKYNHGTSISVSPQMYTTTLHIKFLSYLRIQTSAFRLQMLP

SEQ ID NO: 26484 - protein, 69 aa, Candida albicans
NIIMGCTENCWMQILRRKSIRIAMRIKKNVYAQTLAVPHTEIDNHSAITSSTIDKLISVVSIKLNTLAL

SEQ ID NO: 26485 - protein, 108 aa, Candida albicans
NVGSFRNYSFSFPRYTHIYTCFSLFSYLENFNLMYIVYLELAGEFESVPSKMWKLYFSLTQKYVISVMRANFSFSENQLEQLPLKSITMAQVYQCHHRCTQPPSILNF

SEQ ID NO: 26486 - protein, 117 aa, Candida albicans
DDELKAVLWNDITLIFKRDMAFRDEIVKRSNGTITSLPVSDFITGVATETSALDGADGTLSSLDVTAFINTVSHSFITSNASSSAVITIQSDNAGSSYGPGFYSTIFAVFGLFAMMI

SEQ ID NO: 26487 - protein, 72 aa, Candida albicans
FLPRHGMCVMLNYNKKTRDKTTRIKERRKKKGKGETKKKKFLVATIATWYFNFSLCDDPMYGKNQKGGRDRK

SEQ ID NO: 26488 - protein, 251 aa, Candida albicans
TFVAARGEDDVFKKWNHLDDHLHHHHPQQQHPQQQYGGNIYEAEKFFNSLSNSIDMQYQNMSTQYQQQHAGSTFAQQKPTQQASGQLYPSLPTIGNGSYTTSGSSHKEGLVNNHNGYLPSYPQINRSLPYSSGVAQQPPSALEFGGVSTYQKSAQSYEEDSSDSSEEDDYSTSSEDELDTLFDKLNIDDNKVEEVTIDGFNLKDVAKHREMIHAVLGYLRNQIEQQEKEKSKEQKEVDVNETKLYPTITAF

SEQ ID NO: 26489 - protein, 71 aa, Candida albicans
CGQHNYDQYKGSFWRCLSISMTFQVGVLINSEKKKELKSGDIIGSKRISHNEKISRTYYFGAEPKSYVWTC

SEQ ID NO: 26490 - protein, 385 aa, Candida albicans
INTPLYMSSTVTQTMNNNPTEKVTFTASNSQADFDLLDIFSNDMDFEQAYDMYNNLQEKNAMGSFEQLQKVQALNQQYVSNLQPPSSAQFPDQFAYERAQILNGEYNKQSGLMNDATNKNYSFNDDTFDQFFTNTESNALEKFLDNLANPVASVNPLQFYNNTRTSVPDEDVDLSFELHTMKVPQQFKPRSQSLEHNPPLQQKVRFTEEEHAALKQELTEAFAHPCTQLPSPSTTEYKPKPTTPKVVKQFVTPPNSGDELRKRNSDIESDESEEETTPTTKKRKRTSSKPLLSVEQKRLNHSHSEQKRRQLCKFAYQRCLELIIDLDAFNKLPELNESERKSKRARVNKDGLPNLSKHNALIRISNEMILIKSMNDSLKKLIENR

SEQ ID NO: 26491 - protein, 70 aa, Candida albicans
TCRVKKSPEKGTTHTPIFHHTTQFTNKLSHIHLIITVQPPIPNFWHFNQFTLAGQPVHLESVWVLQHPYR

SEQ ID NO: 26492 - protein, 154 aa, Candida albicans
SLETETSSSCGSKLKLCSGGECKDPMEAPNFGPTIPTLPITSQSKTSVSSVVSKSTTEDNETDCETDVPTIIPSGSVLPTTSVLPTIIPTGSGSITVLPTKSTTSDDDDDETDCETEIPTIHPTVSTTRTFTSDGCQQLKHSPFSHTGPGRIRH

SEQ ID NO: 26493 - protein, 92 aa, Candida albicans
QQQKLITGFGLSSNYNKTNYWTLGRRLMTVLTMGIMETFQNKRTKTIKELRTRREQNRWRLRHLVEFKRFKSLKKIVFNCFPFTNLNFIMEA

SEQ ID NO: 26494 - protein, 86 aa, Candida albicans
NYLIARPDIWLRNVEQNVQNRKIITENKTPVLSTQCIEEMPLHYYISVLWLSQIQSFGFISFFLHKDNWIIFDKSTLPIMSYPNEE

SEQ ID NO: 26495 - protein, 63 aa, Candida albicans
ESSFAAKSICLFYKRNELCVCGQYVLAFQLYNYKLTLLERSRVITETEIALNKVVYFRFYYMY

SEQ ID NO: 26496 - protein, 69 aa, Candida albicans
SVFEIRIKNYEERRIQIKIKKCFELTVPYINVYLISFCEFPKAFCLFLTIHYRNSMFYLYLYYRKRVIL

SEQ ID NO: 26497 - protein, 69 aa, Candida albicans
FLKRFGQRQVQDPLGLFLHFCYLQNGIPEPFIGRWSDYANKAEEIYDTDQQQQRPQPLQQQTPTNSHYQ

SEQ ID NO: 26498 - protein, 78 aa, Candida albicans
SLPSSRNISSRESFKMWLTQVLYYKLKYFVPDSIIRAHHNPAAHKTQDKIIHSSSLYFINFFMIFFSLNTTEKQSDHM

SEQ ID NO: 26499 - protein, 214 aa, Candida albicans
SFIDLMNFDQLTDEQKQQLYLQHLQQQQQLQQQQQQLQQQQHQLQQQQQSYHLQQQQAAYQQQNQAQLQQDDSYMDEDTSELINQPPVQLDHGSPIRQQPQMSAFMPSPRFAQLESFDNHLNVDPNNTERFTSMDSMNFQPPASTFTQLGNGSSTNLSEISSGQNSLLSNHSVNNLPTALTSDTSPPVQQHPQFQPQQLQQRPPVFTSGAGDPH

SEQ ID NO: 26500 - protein, 80 aa, Candida albicans
GPSQLYNEWHFGRQQQNLTYTSKSDIFSKQAKEKKSQQKYTQFKVKENEKYNLSTHSKSTRQNPKSKKKKKSVNFLKPLL

SEQ ID NO: 26501 - protein, 75 aa, Candida albicans
ILLYWNIPILSMLSSKVTSELRYVCKFFFKEKSLFSQWRLSLLVRENNQLKIVHVHAHTLIFVHLIKFFFFPRCC

SEQ ID NO: 26502 - protein, 83 aa, Candida albicans
  UNSURE (59): Identity of amino acid sequences at the above locations are unknown.
IDDRTVLINYSYTEISDQLAADYCNMNNSFILKASPDHSSATVISGESHLQQQQQHHQXELDTVVTAAQLQSSPAGGRKRACD

SEQ ID NO: 26503 - protein, 86 aa, Candida albicans
GNCHAYKSRAKHQIAGCAKEDEAAHPINGGIAPTTAPTHVLMIDFLFMDVYSHAYNTMLENPNNDTVGFTPNHNIPQPIGPLTAAN

SEQ ID NO: 26504 - protein, 152 aa, Candida albicans
SIYKYQIYYSFKTIILMGFTGFFRILQFIFNIVCLALCAAHFRTAKAFALGVSSANMIYNIYTLFIVPQMEQKTFAVLIFVAELAFPILYLISCIILVVKTKADYVTSWTVNFTLQYDKYRDVPYNTVAMAGGIFGLVCLFGFGFTCFAFFK

SEQ ID NO: 26505 - protein, 94 aa, Candida albicans
LCNLCGGGACHEPISLSHRTSHPIVTHGSSYSLTTLLLHLFTINMSTTPLFYYLVYYFYSIYDLIFKFLLTNTINLQNKRKKTNKIELMKKKKD

SEQ ID NO: 26506 - protein, 71 aa, Candida albicans
TIRIHRELTLALKFYFNNHYLLVINITYGLSHFLFFSTKLFKHNPIYRLELELELHHYQLFFNDSIASRIK

SEQ ID NO: 26507 - protein, 63 aa, Candida albicans
LLPKFKYNCKRCFSLFSISLVIIIDDEEDRDDAEAVDDDVAGDDVAALIPGIAFVVELDAEVP

SEQ ID NO: 26508 - protein, 70 aa, Candida albicans
MMPLEYPNLPPNKIVEVRTQTSRNGLTFFIVRFNNYLIREVTETQLQRAAPKLYAKIKSDKRFPNNARCI

SEQ ID NO: 26509 - protein, 230 aa, Candida albicans
DRGSFQPRGEDTPGTSGGTVPTTPQIPRSSSQSGGFASPYLLASGLLSPKSGGGAGPGGIVSSSSPINENGPLRNSTSNSEYFGDITYKSLKPPSRQNSQYASITSGGGSIGFGYGSNNSGLCGPATAIGGGGGGVLSSSTPYSTGSGSTASSMNYNNHNNNNNNNNSVNSPINEFRSSRDLKSSSSPTTTTGTSSTSGKKPQSRRTSDKMLGFSSDASGSHTFVIKPKK

SEQ ID NO: 26510 - protein, 77 aa, Candida albicans
FNSVKYIIHHFIIYLYHRVILLLLMYFTCIVSSGIACLVDFGDTDFQRVYKSKQETLKSIKLSVVVRFLLDTVAVIF

SEQ ID NO: 26511 - protein, 188 aa, Candida albicans
SSQTIDPMISSSTASSSSVESSLSSSTASADSDSTSSKFTRLIQLAVILVIFWGVYVLYASYKSRPSSIIKKPTNNTSNVTRSSAGKKKNVQWADQLNQFEDDERTQEPNQGIIAKAIGKITGSKDTRGRYAPVQRGNGNEYIDDIELGEGLSDPNVDEFIIGSDDDEEQGQAHSGAATHNQKQKPMN

SEQ ID NO: 26512 - protein, 64 aa, Candida albicans
LVVLRYQLIFNCSFLFLVFFFPFSFKSTDSFKISIRFDRLIKKLGCFRWKRLDKWTKKKAKEKN

SEQ ID NO: 26513 - protein, 67 aa, Candida albicans
PKGHTLKKEIGTLTGHGNTRVLRHINCNVVVPCRVKLNTLEIQLSISPTNIHIYGCIIQTLLVDIKI

SEQ ID NO: 26514 - protein, 78 aa, Candida albicans
YNGTIAERIPTDTPDTNLPTHIRAILADAICRMFPVMNISPDDIIIENFLPYRSDAKGAINAPIKVPNDKIATRIDRS

SEQ ID NO: 26515 - protein, 88 aa, Candida albicans
IYREKKNIFTPTSSSNNIHFKFTANTTERSGLHIKPDQTTTAINYQYSQYCQNQQTFPEFFFILAFSIHIDIIFASLLLIRVVNSTNE

SEQ ID NO: 26516 - protein, 75 aa, Candida albicans
IQKKTKQKKIQTHTFNKTHLVVVVKKKLLTKLEEGEVSRQAVNSSSREKSEKVKKNFLIVKIFVQTDTHTHTKPC

SEQ ID NO: 26517 - protein, 61 aa, Candida albicans
DQIINIYNTVELVIYICSYEWMVSIRSCKNLNPKKNEAKKNTDTHFQQNTLGGGCKKKTVN

SEQ ID NO: 26518 - protein, 112 aa, Candida albicans
QRKGTIEYYYIINCICVLYVFHKFMFIVISYTLPLSLFRFIILNEFYPKNVAVITQVTTLLTKGGGVHHNLSCLIVFSLSHTFLMFFFLLCRLSFFLPSSSSSFSSLVNKIR

SEQ ID NO: 26519 - protein, 68 aa, Candida albicans
NIFLFFLNLVLYIYKINKDFFKKVTSYICNNKKKNNKNTKPDFQISRISLLETFVVNNGWTRFVVFLF

SEQ ID NO: 26520 - protein, 64 aa, Candida albicans
YLISLLIFFFRFFDFLICPSHRILLTREEKEEEEEGRKKERRHKRKKNIRNVCERENTIRHERL

SEQ ID NO: 26521 - protein, 344 aa, Candida albicans
  UNSURE (333),(334),(337): Identity of amino acid sequences at the above locations are unknown.
AVRAECKHGWGLLVVASQSYFFFSSSRLTEKLTIRKINKPTFNFFNQMSHSNALPNSPFRSPKKQRMEVIGPLNASRFSFSPVKTPPHGRAGLSSPEKRLVKDLDKSARKRANNSLYNRLMDEYLDTDDYLDEQDRILADRIIKQSRGEPDEVNYGSDVELEIDLTQQRRTRRREKKVVYSSDSSNEYEDTGMPEESSSEEEEADDDDGNVEFVYGPPKERKTSLSSSPPTVKPTVRRTKRGRPSKSELVLGQIKSIFHQDDVLFSTDRKTFTPTKPTAAKKPVSNYWTSIFDQNFDRSKVPSLSGIPKSTNTHEEQQTFVPLPIPTVDAIFXXSGXARNAIGR

SEQ ID NO: 26522 - protein, 160 aa, Candida albicans
ANSYLAKVINCGHVATTYLTYQFPILAKSILNEKYYNELVAGMIERNTLDTNLDHELEDSQKENLYSFERNNFYKNEIDYTRCLAMFPIDKQKLCHVKIKVLHDIQYLKSFRERQSDKVENVPRDYILYDCFAKTQINAQIVGITDLDTQLFTIGFCKMG

SEQ ID NO: 26523 - protein, 75 aa, Candida albicans
PHSAQSPPPYFYFKPQPRLYILLFGHFSLSSSNSLLIRKYTNRLLLITTMLSNPIIMVYKVGDKFDEHKKIIKAK

SEQ ID NO: 26524 - protein, 75 aa, Candida albicans
HADSPACGEDGATLSLPYKMVLKATYNRLPCNHCLILLENLRSILFFLYKQSITETRNDNKQALIMIITIYNIIK

SEQ ID NO: 26525 - protein, 106 aa, Candida albicans
VIICPVCLSICGIVSIFNLNSLVKSISSGLLSFDNNLYVFPFIIVFARLHILMINNVLSLPIEEEDDDDDGGWVLSMLGPVINSINSLDTLGDQNFISVFSSRPTV

SEQ ID NO: 26526 - protein, 100 aa, Candida albicans
IEINENLQNLAIVEIVDLVNPRNRRNKNKSVDDDTESRYVGRKNFKKFKKNKQLSSNNNNNNRRRIGLYTVEDNSNEDEDDEDEEQNDTTRDENHYKGYF

SEQ ID NO: 26527 - protein, 182 aa, Candida albicans
TSLGVDDKGIQESIYIPDPGGMMVLSSQTLEEGSREPCIGLWLSILPYNLYCIIKFCYSNIIQKLGLLKSVLRCCQQKLGAKIKCRTITQIITKYLSFFNSKTVYSSKGLCYYRVGNISINEIWIHIGIYLVEAFCHFFTQFPCRKRKKKATSRFFLLITSLNTTTQLLSIVESMLIKMIEQ

SEQ ID NO: 26528 - protein, 102 aa, Candida albicans
DTSKERQTNPSNITPTTRRNGVLEYDKLTNNKKINKPSIEWDKFQLLEYINKLERSRRVERARRVAYTALIIYKLKYLDEHKKRYESMGSRLNTIRNFTTSG

SEQ ID NO: 26529 - protein, 78 aa, Candida albicans
CDTVTVMVTLVRVVVGRYGAPTVAPPNNLTLQLHTGPILIFSVLVQFNPNFPTARFKLRGHKITPTFNQLSKRIFFPF

SEQ ID NO: 26530 - protein, 80 aa, Candida albicans
LFVLSVVIFVITILSENFIHLVIKNRDPKKKPFGYFPNGDSNLPNTYLVTLHFSPQFFCFFFSLVIVDCCGVVQCSGRFY

SEQ ID NO: 26531 - protein, 412 aa, Candida albicans
LFFLPAMDKVLFIIHFLLYNIPLIHCKLFYNQQHKICNPKQLTPFFPFTGFKITRQYKISGYTLPVSMHFITISHCNHGQVDYQKVIRTDSSGKIDWGKPFCMLKPKLGEMLTLPDHDTIGDPETQDYHNTEETDDFIIGIFGFIMYKGNKLSRLLRKKIDIQLEKLTNGKWLEYTGKNKNLHQEDLMMTKDPQASLQWESKNLVCYKMARRKKYAKRKFDFYMPHTFVGGLFECILPMDLKQQIFHQFTSLDLIFQQIQIQCDPNLSRPISPLIAEDSTTQWFENKLYNIVNPGIIQTIPYLTTLTPLNLRFSTSETPDMFKDSWATKIEVNENYVYLEADIHLISRAIALSNDLLNKLISPIDFNQLIKLYNKANERENPDMEEFLQDITWTQKIHLWLSTIVEKYQIKY

SEQ ID NO: 26532 - protein, 93 aa, Candida albicans
FLFSSWFLSATSMGFIRLLLLFHDGVADWRVKREFINENKKKNSFMFHISSHYKILKKKKYIYTYISREYHATNLIINFLILFLWLQNGFQLF

SEQ ID NO: 26533 - protein, 119 aa, Candida albicans
PLNTWTVVVFSQFLVLPVVPFITKFNRYIVLGLLVVGKFGNNFKAIPDGFSKEKGNYIYKEYHVGYAGGSGVFLGRYGAGLPGGGALQSELGDLGEQREGISRGSEACRCIERHLEWQD

SEQ ID NO: 26534 - protein, 92 aa, Candida albicans
RFGGACGVHHFFATPISALARVNLVLHEHPVVKYKTFTRVRGGDEPLLSGEEERYGTEDERDTETPLVEHNYDWSLQYLPGLQFGVISIRRS

SEQ ID NO: 26535 - protein, 64 aa, Candida albicans
PKRGSVQPRGEDTQKIDSLTPFSKFYSPVSSLKLIFLLYTITSLKLYYLLCFNSLFEFPYFHPN

SEQ ID NO: 26536 - protein, 62 aa, Candida albicans
INNRFFHFYSSGNFSSSKYSTKKEIPKQQGIVNKTWRRGEDKGGYCLKSLQHVSSHLFESPT

SEQ ID NO: 26537 - protein, 98 aa, Candida albicans
DYSAMEKSSFFRNSSSCTKCHQPNTSMVSLGTPPLFYQKLLVIISDRRSWMSNHGGVTMKRKMNYTLELIIGFFISIVLEISPRANILQKKKYQNSKG

SEQ ID NO: 26538 - protein, 68 aa, Candida albicans
NSSSIIMLYKKKIQTLLPFKVQETNEKLKKKEGEKKNLLMYWGHFFKERLREKERKKFFSTIIITIRI

SEQ ID NO: 26539 - protein, 113 aa, Candida albicans
DADTMVSLSVKDSKASCYIHQRRIVSTRRLRRISLCYNTTNSIPLNSLRRRFKQVAGYVLQRFQAIPSFVFSSSPRLINYPLLFWYFFFCRIFARGEISRTIEMKKPIINSRV

SEQ ID NO: 26540 - protein, 72 aa, Candida albicans
QLKMSAPKVATQVFLKTCSSGFIHTKVNGDGLQFLKSKKFPSSRIKRRSNFKLKLKNYPRNPTQRNLVRKSW

SEQ ID NO: 26541 - protein, 73 aa, Candida albicans
LGKPSLHTISITMLEMSIFTDDIKDGRTSNNFINSGLAGVSATGAPDLLSICSLHGHTLLTSIFFHSSNFLLK

SEQ ID NO: 26542 - protein, 331 aa, Candida albicans
PFAMKLDFATATLVLAAISSVAAAPAADAQVKVTQLTVRESNLVNSALANLQHYNAKRDLMSQEEIIKRENQIVTDVLTAIKNTNLSPGIIKYLITDPTLSKISVDVIVGAIKNGTINLTTLLKSLNDSGLAVDLIKDLINDCAFYAYIYKAILDKLTSLPNLIGNALGLNANTVSSKMASAKREIMVESAPEPIYARDGQDVLTSLMESLKSSGLANQVVEALVIDDQFYKWGGDLIKELIDEKAITLGQLIDALADSGLIPSLFQAFLNFGTLKSVIVTALAAAFGKCQNATPTSSLKTTPTGTATVSIPTATGTSGPVTCKKKKRRNY

SEQ ID NO: 26543 - protein, 138 aa, Candida albicans
LCLYQRLMVEWTCFLSGAVSMQRQCWKDSNLLYKSICTKNQIKIIRGPRKKLKLDVHLDSVALVIRLPRKVDVMIQIDRTRLNNALVLKSADIVNCRLYLVDSSTKFWARLLIIKEPNFSIEFHQFDTRWLILAYPPD

SEQ ID NO: 26544 - protein, 61 aa, Candida albicans
RKRKKKLLDVVNFDKIFRVGICFLKETEIEKENRYYKVEHTYITKRRNVDRCIRFLIYTNL

SEQ ID NO: 26545 - protein, 69 aa, Candida albicans
KMVFQHQYITESELVFGVRTGKKNRTFGRKTEILISSPIILKRLAFSFYLKIQPSKDISRLSKWSLTYG

SEQ ID NO: 26546 - protein, 408 aa, Candida albicans
LVPQSRSFQPRGEDRTLWSTDILKIKFGLASEVFLIVSTFIIVSANLILAQRLFTWRHPVGGSRKLFWGFMFATYGMVLVVIAITILASFVPYLYYLSEKSYLSWVKTVQFTSVLILAYCLTSVALIGLSFWLPTKKDESRYTYQPWWIESFAPFYFVKKGAAQEAEATFMKRNSNHRHATRVIAATHHHFKMVKGLSTERGDLKHNVSMGLLIISTVLTLFGSIVRAIVVFQAREHKFASPAESIWFGYLCWGVFESIISILYIVCRVDLRFYRPDILPQAVRAIITAQQSYYPSDDESGDNDDNHNYKSEIIDKPEPQQQHVYAKHIGGFRGDEKLVVDEDEFDDIDFDEWDFGEVKKDRTNTSSDQSFVNSSSHWEKGRAHPTQIQSSKSVKYQDTKEPDMEFQF

SEQ ID NO: 26547 - protein, 553 aa, Candida albicans
LFYCFFYPSINHICHLNFQFYSPSSSKKKETINSKMVVSDYSATQGLMALLYSLNKGATTGTGIKKLVDQAHNLIGPNIPAAVVDYNVGTQINLFGSYPTRADIAPSIVFAVIFGIIMLIHMAILIINTSRGHHFYLSYIWIVYSMMKVIGFALRAKWGTNQTLVAIGLTSEVFLIVPAVVIVSANLILAQRLFTWRHPVGGSRKLFWFFMISLYSFVTVLVAVTVLASFVPYLNFLSWWSYRSWIKAVQFTGVLVIVYSLTAVALIALSFWLPTKKDELRYTYQPWWIESFAPFYFVEKNAAQKAEASFMKRNSNHRHATRVIAATHHHFKLVKGLSNQRGDLKHNISMGLLIITTLLILIGDIGRCIVVFQARQSRHASQAANIWFMYVCWGIFEIIINALYIIGRVDLRFYRPDVLPAAVRSIVTAEQTYYPSSDEEEDGFHRDRPETYGKLRGRAEYGHATPNRHPAYGREDQELAFDDDEDDYFEDIDSQEWDFGGAKEKVSSSTEDTGQHPFGITQQDKKDEPPYPVYNSDKQHARFDDDNESEFNF

SEQ ID NO: 26548 - protein, 213 aa, Candida albicans
  UNSURE (16): Identity of amino acid sequences at the above locations are unknown.
DYSLKKKMTEHSSRRXSLTSMSTTASSQNNISVHDLSTDNLIAVDSKFVKKPTKKFPNSNGISPKLLSDTSFRSPPSGGSSFYSKEGVYYFPNGEVFRPRTTPAKRNRPNKIHTDSPPTKSENTFSPVDTIVPNNSFATDSPTHSPVHSTHSSSANSASTLPSNSGKTSIHSNNSLTSLPKSASLQNIKVLNKQNLVLTISSHKGFQQPPKTR

SEQ ID NO: 26549 - protein, 311 aa, Candida albicans
FRFCKPQTFDTKPCTVAMKILLIYSMTPKLVIWFTLFVLCLQMGDTFDISINNEEIDNPGLIIKSKFKKYLPELQENLEIPITEKQQSIKESFIPRRINYPHYGLRSRFRKDIAILETTTTTTQESETSIATNGDSFDSDNGENKSDSSDDESSNNEGNDKSDATFKSLSSSAPTVVHSRRSWIKDFLIFKEQKVSTMSSSSSSSSGSLRDKSKLKQENKQLQSRIKNYDDTVSDPRDLKRWVRLIADEGKNEFGKKHSSKNYIQKNEIELDIEEFIHYLVEEQGFNSSDLEFLRLKNLDYGLGEIGKRIE

SEQ ID NO: 26550 - protein, 78 aa, Candida albicans
EQTIQPQIDCYTTTNKNNFIDTGNKVKGKKKNNQEEFQINLSKPLNTKSNEKQFQHDESLHFLFSFMSIMEKLQILNY

SEQ ID NO: 26551 - protein, 214 aa, Candida albicans
RQVYDYKYHAYFKAISTYYKQFKAETKESLSKWDDLVVPNYLIFKSTIFQDLDTNEPVKFRQITHQFNKLMDHIVNQTTIFDKWNENVEDGLMQDYPWYMYYKKLQHYAEYKVSNYKLAYLENDLLLNDRDYLYLRTGENGAIIDVPNYYYDSIIYGQQSFNPNESNQEFFDKRYLHGSFTYLYQSILNEDFEFTVKWFVMIYEKLNNIDYTMT

SEQ ID NO: 26552 - protein, 190 aa, Candida albicans
EITAMEPEIPDPNMYIEDGSHFELPRDSEHIFNLEFDYNDINDEGEDDLIDGANSKNGSQQNSMSFDGSGDNLMTMDSKLDKFYRYIKARSNEFGKLVVGTYLISQAINEYNVVLAEHTGDYYQTKFQILVPDSTHALDIEAPPVPRRVAAYAFACVLTLATKSLINIEVIQETDELQNNNDINIILPLE

SEQ ID NO: 26553 - protein, 92 aa, Candida albicans
ISSSSSSASGLFHTRVGFGCLKIDVWVKNFRAAQLFRYPINMTITASEISPKYQLPGPRFMKASCSPNSKSIGQLTTHYVMESGFLYNIKLV

SEQ ID NO: 26554 - protein, 73 aa, Candida albicans
VQRKKERKDVFLFLFLYILYIIFNINLNHNIDAHTNPVAFLLCLLFISFKGGFVFQTIDWQQPKFNILCSVYS

SEQ ID NO: 26555 - protein, 77 aa, Candida albicans
FLKMNLSYFYGLTFVSSLLVCGYDVIWNNVLGHGIILHRLGTSVLFLLCRYDLLRKKKKLYQLNVVKETRLHYVMSG

SEQ ID NO: 26556 - protein, 60 aa, Candida albicans
IRSNKIKKLKRKPLFLKFEDACWLSEYFSSCFVILHEKSLKLVVKWLLKNCTNKHTHNYY

SEQ ID NO: 26557 - protein, 78 aa, Candida albicans
CLSCSRTNSHEYSGEKGNYIYKDRNGINQLELYKLDWNKEYLVGFEWLPDIDDEGGYASGSGVLLGGYGASLPGGGAL

SEQ ID NO: 26558 - protein, 82 aa, Candida albicans; identical to SEQ ID NO: 23926

SEQ ID NO: 26559 - protein, 96 aa, Candida albicans
SGLQAVVRTGNPSELIGYLIFLDEVDLLSEEEVVVVVVVVVVEEEVELVGSGVALPFDFFDFFFFLEEEEEVEVLPSSLEDLFDFEDELEPPVDCC

SEQ ID NO: 26560 - protein, 66 aa, Candida albicans
PQPRLIKGGGTGLIYGSLTANKNDLYVLATPNSKIPQDLANTNKCLTKLNHSKTTPCCNHHNKSTI

SEQ ID NO: 26561 - protein, 137 aa, Candida albicans
YPLPLLRSNLTIMSSDNFFIKNRTAIIVTALTAFSAAGAYYYYTQQQSTGGSNSSSKSNKSSSEEGNTSTSSSSSKKKKKSKKSKGSATPEPTNSTSSSTTTTTTTTTTSSSDSKSTSSKKIKYPINSEGLPVLTTA

SEQ ID NO: 26562 - protein, 119 aa, Candida albicans
TNKNNFITPLFPPTMPENLQTRLHNSLDEILKSSGYIFEVIDQNRKQSNVITSPNNELIQKSITQLLNGEIQDFHAILYQTVSKLNDAEWCLGVMVVKKKIHDELKVKEEAARKNEDEA

SEQ ID NO: 26563 - protein, 66 aa, Candida albicans
LWSRSHRFFCSIKYGCAFTLILHFHCKRVKFYFSQCYKKKAKTHCYYALVNLIQFVKLFIILSTMC

SEQ ID NO: 26564 - protein, 62 aa, Candida albicans
LVNVIADNERKDLVLITIDGISLDSDFAHTFFLAILYDDLFIATIRFCNSRSLHAVIFRGSK

SEQ ID NO: 26565 - protein, 73 aa, Candida albicans
SYLSVILASENVDIKESCENVFPVLSTCNYNRPHTSRSTNYLVHYSANFTGLGDYGQDLIDFFVLLNMVALLL

SEQ ID NO: 26566 - protein, 73 aa, Candida albicans
LLFKPYIILTTLNNRRQSNKVMKDVEQRNKNERKRTRFFSNEDIPCNLETHRQTKKKNLFLLPTNFLSLFLFL

SEQ ID NO: 26567 - protein, 73 aa, Candida albicans
FDKKKMIMNKAYFYGWHLGSCSLEVKELIVTMAQELQLNLAHPIFLTMADQLIEHTILNLILIGFITSDQWFY

SEQ ID NO: 26568 - protein, 62 aa, Candida albicans
YLETSSFIWQFNFILLQILHILLFATSKYDCMQTPTVAKTDCCDKKIVIQNCKKKSMCEIAI

SEQ ID NO: 26569 - protein, 77 aa, Candida albicans
EIISSTGITQLQQYGKVSRKTPKSELPTLQFGLTRPKVKHFRLNGGKVLRDLLITVAVFSLKAIMGRFEISKRAGKD

SEQ ID NO: 26570 - protein, 74 aa, Candida albicans
NCLLPIVSNIYKLFTPRILKFNITFKFTFHFCTVVKYNNGDAYLDVKYYAFYILILLFWERLLLYYALFNFYLI

SEQ ID NO: 26571 - protein, 124 aa, Candida albicans
FTINCLISSLWVFWVSIYQFFRFFFSLKVNNYYSNNNSNMLSFVEVKPDFVFSQYEISIIKSIWRSLDLNNPLNLKDFYYTVSAAINSTGTVTTNGVVSPKRDKFTSLIITQQDIANTISDYQV

SEQ ID NO: 26572 - protein, 96 aa, Candida albicans
KKGQLEERSIKSKVFIKYAKMRTFKKISLSQGLASIYINIKTIHFLLFRCAYQKVFFVSSFYSNKITMHNTSGQIRAELAANNRLQVKQSVIVYQK

SEQ ID NO: 26573 - protein, 167 aa, Candida albicans
LVILLFSISPSLVILSLPVMALNLLALRYNNVLPKVSGKVKHNITNENPEMIHMNQKVHLQLALTVKIEPKNGPKLGPQTAPKLQAANPTGKFQNLTTSATLAPPVAKQGLAKNPPKNLNIHKPAILFTKAVGICSMTNKNNVMIYMDVRPNIAFSDIGLKTNGPTP

SEQ ID NO: 26574 - protein, 647 aa, Candida albicans
TMGNYKPSIKQYVVTVKAIKSSQFGRLGICAVVLLFVLGYPFYFISNNPFDTSIRYQYVDPYNDTTRKYTTIEKQHTDIGGNGTTILYPKNLQLDQTALLQLLNTTETTNPFVQYIGNSSSIAFSQLNQTLVNHSIQVFDPFSNSDNCLDLMTETQLTISQNIIIKELFEIMVKRLMHQLDTEPAFKELAPFFQNKLSLHLRMRSYHKHFYKFAGTSVWLKDYGVHLMISRVIYSQKGKKGDPQISLLYTQLYDTNWQELTNTDLLVSMQDITGEYKLEKLQFPRLLPMPFYYNPKLTKGRWYGPEDARIMLVKNQLDMEEPMVIYNSYHRQIANHTTTGKTDGSVELNFEFYRSMFVGWPFRYQLGKSNTDGFVDDRFDNVKFTRVAELKIHNQTRASIEKNWTPFVDPSERDPEDKSLYIVYQWDKLRILKCDISNLVTDDGFIHYSACRFKQDTKHDEVEKVGPIRGGTELIPTIINNKQLWVGFLRAHIDKCGCGKAMYRPNMVVLQKTDMGTFQVAYLSSYISFNIPVPGWKTHEIQCGKRDPNVLIPNGISNWEVATIDGIERDVLTMTLSAADEDNILMDIHGLKTVIKNLITNQKHGNEFNSDLVQMKCVVAYSIEFCRAYGEEQARLGLTGGWLPLHN

SEQ ID NO: 26575 - protein, 341 aa, Candida albicans
  UNSURE (13),(322): Identity of amino acid sequences at the above locations are unknown.
LVSPEISFILLSXYLLLMLQPLLKRRLSLYPWRHVYIRNYSNKQSQNAEPTPEQEVTSAIVDRMKQILEEKISSQSASTIQTMKRTDESLNQILSKYDTPSTSLPNSKQASSYIRSEPILAHNKHAKDIYNSIPWSGAESVYDSNLRMIVDSKPKPINDPASLAYKKRNPTKNEKLAMARDISLDYKVNKPQVGKNKDTDDDGFREMYRERLLGPSMLLNHSSTSVDFVEMLAGNKINAKIDQTTGKFETDDMQKVRGKPLEKQHLVNCTDSNYFINQVLNKQEVLPPWIESQQKLNRNIAQFRENLVEMWSKSKQLHESDXKYIETKINLLNHDIRHYNL

SEQ ID NO: 26576 - protein, 67 aa, Candida albicans
CTTQKKSDKTILNLIQFLLKSLMFVSSLNPTKNYKQQPHIDQFRSDKEYYKLDDIDLVVNSKRVDSV

SEQ ID NO: 26577 - protein, 86 aa, Candida albicans
FFFKKDWIDEALYIRLKTIFAGSAINLGDYFSITNLCCFVTFLIFCSILHDYLLLINMSPKEYFYLVLHMFFDDNQLLQINLHFLI

SEQ ID NO: 26578 - protein, 80 aa, Candida albicans
LGLFKFLLFLFLFLTLLFLFPLIISLVVGVILIFAYIFAYIVIFVIPLLEFFFLFLPFSLLDFFIIVCLIQWFSSLKILV

SEQ ID NO: 26579 - protein, 352 aa, Candida albicans
LKSFVQKTTTMRANYLLLLAATAVQAAPFIKRYENTTAPASQLSTSLADGSTTILGSSSSSVEEDETITSTIVQYVTVTSSDTTYVSATDTLTTTLSTKPTPVITTEAEDDEEDNETITSTILQYVTVTSSDTTYVSATNTLTTTLTTKAAEATESEEEENETITSTILQYVTVTSSDTTYVSATNTITSVLTTKAAVSTNDVSENAKAATTEDDGETTTSTITSIVTITDANGNTEVLTEVAAETSGAEDASYCVPTTVTVTVTAEQTSEVVSTIVHTTQVPLTAEFTLDDTTTTLTSWVDLTSTDLVTITSTSSVYDSYSTGASQSHPISSYSNYTISDYAPPISSYYSL

SEQ ID NO: 26580 - protein, 78 aa, Candida albicans
PSIFQYSFQLLFQTFSCSIPFICLLFWSCVYSIVTANKSEKKFIPTELLQQMERKKKIFNTQGRVDLSHLSNREIWLA

SEQ ID NO: 26581 - protein, 85 aa, Candida albicans
NKLVYYCIIIYVEERRGKLKYAKQVVKTKIKNEKHKEHTNLNKTVIVIIIIFVLTRFICQLFKINLVSQYSTNTTETLYELGTFR

SEQ ID NO: 26582 - protein, 123 aa, Candida albicans
KPSHQSCPQKPNSTYMAKKKSRSGLLKAPKTITGKHGVPKSLKPQRAREIIRRFHVLQKSKDSVLAKLQKIIPQISKNDYHQIEEMSIYQDSFKGFVLPLKYSENPIYKIDHTLNKNDLITTL

SEQ ID NO: 26583 - protein, 75 aa, Candida albicans
PYIEGQFFTIIIKGMQANAIFRNNIQKEHFGAPANGVLRGTENERKERNCNNLSIIHNTKTYLMSFFFRRHLMYC

SEQ ID NO: 26584 - protein, 61 aa, Candida albicans
LVCICKECQEINGDRNKEREKEKKPTAQAACLVAIHYYNRYYKILLKHDLFDKLLLMIRIL

SEQ ID NO: 26585 - protein, 63 aa, Candida albicans
NMFSSKKWVYVIKFPTSFFSFSSIILNSEVANDRHVLSNMGTTTCKMPEYTERNCHFNITECY

SEQ ID NO: 26586 - protein, 66 aa, Candida albicans
MICREFWRLFYIFEKSLSISMALYSQSSWYIIFSIHFATVLVEKNSSTKILNRSKNIVILPNYQPT

SEQ ID NO: 26587 - protein, 101 aa, Candida albicans
KHYMSTMPPTSKRTRKRTRTDDNAEPTIQDPSPPLANVEPTIQETPPLVEVSDETNSTEINETNSNTHEETNVLTNVHSSPIETVTERNFNFQHLRQIETL

SEQ ID NO: 26588 - protein, 75 aa, Candida albicans
LMCTPLQSRQLLRGTSIFNTFGRSKPSSDENKLILALKTKTLLIRVFRLQGLTIQNILFNIKFINDLYSMQLIYR

SEQ ID NO: 26589 - protein, 68 aa, Candida albicans
KLCKLSRLCVQYFNPFKEIFAFGYNFIVSDMNQLVSSSNSSKKTYGSNLKYSFQCLQTFGFSCNVTPN

SEQ ID NO: 26590 - protein, 64 aa, Candida albicans
LAIKMIILKERIERSIADIFFYIYGGFNLVLYSLIRYFSPTADNRRSKLLSPQNHQLQINPHKW

SEQ ID NO: 26591 - protein, 64 aa, Candida albicans
NRHNNILVLEHIFTIQLIILSVDTFVERMIERFNTQTHNEKREISLYCTCTSDQKLIKVACKLT

SEQ ID NO: 26592 - protein, 595 aa, Candida albicans
NKYYKNNDTTMDRSNRLLYPRTKIDWGPGENHICLRTSTKNYYVIELFHQSPTLDKLIPLFINDINSSPNLFQIYYQIAENLTQIVLINNYPVNKVRIVGKIINEKYKSNDNYNTNTNTRTKSGNGQGINDVFLTIDDFVGSSSRIIVNLNQSKFRSQGCKLNMSNRGKIVEIEGIINNKYIYYNRYNNYNNYNNDDLLQREIDVEKLTVISHNGNEFHIEMENWKNTFEFRNLNLLEPWVFIPSPQRNKDCQQQPLTYRFTEAELRKRNNRQNLVISSPSPINEIQPEELAFEDSLLVDAVRKSSDKTVVDSIDNDDWPQESGFEELKDDSAVVQQQQQQQQQQQQPNLPQIPRSSLTSRQATLLTSDTAINGTSLGLFNQLENISNKKDVTLKMDDDDNHDDDDDIIILAVNDNPVKVVTEFQVTLEIIKFIINKNFTKFKLVEIYRHNYISQLLTNLTTIQLSTLQQIPNFKNLTSFDEYKSIIFHRIRRVLQFDYELITVSQTQLVKLKNLQNLFYSLIQILHNLSDTEKQLNHELNVMDYIELLRQEKLIFGGINYKIINGIIDYILTMVLKQDRLWKYDTKNISWKYIG

SEQ ID NO: 26593 - protein, 105 aa, Candida albicans
LGIKVIIPPHLVTEKEKARTPSAPQSERKKKIPPHFLVGNIQKQTQSGGGGGRNRNGFLLNSLCCISNATVLPSNGKLLWVMNFSKEKIIFLLHVKVFHSKYEQR

SEQ ID NO: 26594 - protein, 156 aa, Candida albicans
LPPSLGISGAKPGSSGIDPEVVLENQDNEVYGVIPKVPLPSFNSPTRFCMKTGYLMMQVNQPSEEEYKDDIKKTYLVYEINLLSCSNYWNLDVLMKLIMLQYKQMIALNDILCMNPIVGELDILGTHSRNNAIVPWHINAVGKLLDYLVHIYVDKD

SEQ ID NO: 26595 - protein, 65 aa, Candida albicans
  UNSURE (33): Identity of amino acid sequences at the above locations are unknown.
FSNTTSGSIPLLPGLAPEMPSEGGSYEILKRIXICWCNEKLLLRNATSNCLGDVDKSPSLKQLGE

SEQ ID NO: 26596 - protein, 72 aa, Candida albicans
LKDQRGGITVRTCILNTTTTTQQQHHNQSINQSVCLIDRQKYTTNKKNIEKLKDTNQQQQQEKFNFNLGHSI

SEQ ID NO: 26597 - protein, 121 aa, Candida albicans
KTPTNNNNKKNSISTWATLFNIHFCSFKTTNHIYIYIYYPIMFRDRTNLFLSYRRTIPRDSFPTRRTRFSDLNNEEENEGLILSSTTGNQYNRKSKNKSNLKQGVNDLDILQPRRLEGPAL

SEQ ID NO: 26598 - protein, 68 aa, Candida albicans
GFKKEKQVEVLWKNMKKKRQFVFSSALFFFFLFEMRTESLVENFLYETSYKRRSHSIKKFSKCYHFCS

SEQ ID NO: 26599 - protein, 77 aa, Candida albicans
CVYVYYSSLFFLETNLAVKKLLPNIFFSYFDCKNTQSRLEHFIDNILYSLYFWDLPFFFFTFIYFFFVLEGCLSTEL

SEQ ID NO: 26600 - protein, 61 aa, Candida albicans
LRTFYMRLHISADLTLLKSSPSATTFVHKIQLLLQNKQRQISYLIENGLNVSMYIIQAYSS

SEQ ID NO: 26601 - protein, 69 aa, Candida albicans
KGGPTLNCNPDLGATFDLEFKSSNTESDLKSRLQALFFDFCFLWKERLVMNNSRPYNSVDKQPSKTKKK

SEQ ID NO: 26602 - protein, 73 aa, Candida albicans
KSSKCIRTELGINSLSAFATVVLPEDDAPPRATKMTCFSLPVVVILEKGGGGGGGKTKTKSNEILKKGGVQQN

SEQ ID NO: 26603 - protein, 69 aa, Candida albicans
INNGIQTTPYTNQTFLAPYKGDETKKTSYFNETFKKKKRKRNEKSTVIIQTYLPVFDTNLQESKIVFNV

SEQ ID NO: 26604 - protein, 75 aa, Candida albicans
IKKKKIEKKRTAKTRKQKQKNEKKFHVSLILHNQLTTITIYLTLKILYNITFKQQKNNNQQIYYYYYYSTRTLLQ

SEQ ID NO: 26605 - protein, 202 aa, Candida albicans
VAISFFRLEGCNNKIDNKRSIYDILVRLLLRVLIDALKNLAKVDLYEKIPELEYHINSMFTLFPEVFANQQDQIISLMSERNSNNENANQHSNMIENGSSSIGCSSSSTSSSNTIIDSDYQKMDLDVKNSTSLPQSFMNTPGMLNIDNGNMMLMNGNYDLFSNINFENIMSDETFNNMIFSELNELPDFFNSPSLGFNEQNI

SEQ ID NO: 26606 - protein, 70 aa, Candida albicans
CEYYHLKLGETIVNLIYLSMKRRSMCDLSSPSLVPSGFSPLFWYIQIYLTLTTFESESEIEIVNDGSTFS

SEQ ID NO: 26607 - protein, 225 aa, Candida albicans
ISLSFFKSSKQWNSSNDSQDKQQNSTICVNKIVAIELIVRLMLRVVIKVYELHNNVEILANNPALQNHLQEAEEKFPDIFQNHAEFTSKMIALVGASPFGGCGSRNTSSCNLRDNSTNHGQNNMNPSPTITNNTYNSNINTGSNSTGEPQVCYAQSPSYNASLSNIINNESTGRSPATLTSINQPMMNENYDLFNDYLIDNSTVNLPFSQFNNLPNFYFDNNLGI

SEQ ID NO: 26608 - protein, 108 aa, Candida albicans
RQKMNMKSQLSRIWMMHPSMRQYQQRNQRLTRKPHHEGDHTSIEEDGDEDEEEEEEEEPLTLIYTRLNKLLLNFLLRTQSPPVHFMKQYLYSPHIQVLFIFVNPILKQ

SEQ ID NO: 26609 - protein, 62 aa, Candida albicans
VYNNSRTVLRPRLGKLMHKQTGCINHPFLAYQVHIVAANLLSSSWAHIYHQLLHYSEISNTI

SEQ ID NO: 26610 - protein, 60 aa, Candida albicans
PLAIINHLAKLMTDTNTSRESNEITAENEHEESIVKDLDDASVNEAIPAAQPETDEKTTP

SEQ ID NO: 26611 - protein, 94 aa, Candida albicans
TNCLFCLAFFSTLRFLLILLIHNLKVDCRSHPQEVISNLRAEANIIDHKVHKTTRVYMSVMKLLIIRTYADSTFGSSNSTAIYMFKLILLRGQP

SEQ ID NO: 26612 - protein, 279 aa, Candida albicans
TKVQFLPMYSQSRNFHNHNTHFNECMFFNPETPQQICPRVWLGPHNALLNNTDNYGSNFLVQRNIKIIINCGTTLPFLDLIENNRDVAISSDVLILSLDPFFQSHDELAANFTRKYSRILANYLNYFYKSNPNAAKLIHQLPNSTDRIQISSPILCGANLMMQFFSLIRLINLFKLINQEMEVLIISQDGNDNLLTGLMIAYLMDTYRYNLLNSFNMIKSRRPSIYDWSSVEYDALLKQFYTQNCEIKCTPLMDTIKRSSQEDDSELMAGGDRKRRFLH

SEQ ID NO: 26613 - protein, 92 aa, Candida albicans
MTEISQYFFPCAEFSVLPFVLYEEKVVAYQEPAPKNPFYVPWRRFFSLVATDVNGPNTTDKKIKPCATIHLSTMESYCLATYFSFFIEIVST

SEQ ID NO: 26614 - protein, 64 aa, Candida albicans
MMSHLHVYNDTELTLLLNSYRVLPIGEEVRNHIGSLHNFFFLIFLWLNAMEINVVHVGISNREV

SEQ ID NO: 26615 - protein, 60 aa, Candida albicans
VIQINQLGNIKRSCFEIYEKSFKVISYVLLILHLHFTLYNYSCLTNGIPASFILTANSNK

SEQ ID NO: 26616 - protein, 325 aa, Candida albicans
PQHHYHSQTLHIMKFVLVLARCRISIIPKLTFPRIPFHKNYSLTPETSLNRRVGKETVNPRLKTLDNFDPEKQPNETSAVYTRFGWFYIPTEFYLDGKIGVEIQNSLDDKGVTLETPKSEIQKLILEWCRQQPYEPKKKIKQRVKRRTPDVILNKFFSNGKNGSVEEEKPEPLVIEQKRKPSDETLARRIERETYRVTPRSIFARYDENTGKYEIKGHVSQNAAFQYYLSKEWDNYKGQFKTKVETRVALGESWKKKTPEEKEALRLEFLEMLQNGQDLASGKIIPLESRLSTAVFNDGFRLRVRSDHTKNLMKIKQSSNEYLKN

SEQ ID NO: 26617 - protein, 366 aa, Candida albicans
FDELNMNIEAEDDDDLLNELDHELKNTQTSKVSFKKKSFNKPQKIQRNKLLFNIDDEEEDEEKEGHDGEKNNINELKPVPSKGASLLRFNPRTKFTKEKSSETEQPVKKPINLSRYQIDTKTTTTTDNADQEIIPFELDEEDPENNPVITNIDDLNDEDNEEFAKLKSKLIATTTTSQIFNHSEVLTSANKDTPKRYVPIETNRVPESLKLSIRQYTKALVNEYKDDKNYDDGTERQNQEDQDLLLHDINDGDIELNDEDMGILNIGKRANFDDNKFNFEIHSDDDDEKEESDDRLHSENESNDNGNIDFRIPTVEEQIMKINGLIKQLEVTKSEKQKLVQNLKIERDELTETKLELLEKLNNLVI

SEQ ID NO: 26618 - protein, 340 aa, Candida albicans
SRATQEKQGVSLKFKQFIAYGKAIINFYKSGIKNVWQNQSILKKLKQDFYLTHVAPSGQEIKIRIPSFKKLTEEMSQRIYMNKVESETLEKMTKGDIKRSNDMKTHSIFNLTREQFQLYKRTPNDYYKIPLFALVCLIFEELTPVLCYMIPEITPSTCILPNILPRVWNPNAIGKMKSLNQNLDENSMIDLSLKTSYNLDIEHVRLLSQSLRLVSRYIPPQFYPDGYLRDKLQDYYNYIVIDNFYLSGLNGDGNMWNLNDQELVLACLERNLIQNIVYDTKLFNQISDPIQKQMFQDKYMGKLRVKLFQYLVDFDSFNIGYLAVNHAIPREEEVNVIAWR

SEQ ID NO: 26619 - protein, 82 aa, Candida albicans
YKLLATKLHMNKSPRFYRLPSKKLVFLNELSKSPRLSSIWQSVDSRCMNATKTLPIIIQTKQEIFNQVVQSNPGKTRSFFKI

SEQ ID NO: 26620 - protein, 110 aa, Candida albicans
KSTLSLKSAIPKFLTIGCLGLCTSVPLVVVNPYPLQLSTSKESLIGVAVNDPGKAKTPSRGCKFTNTGVLFILLAYADNIFSTVVLPEYFEPIINTFGPLCCWSIELEKL

SEQ ID NO: 26621 - protein, 63 aa, Candida albicans
KENNINCLFHLNNKTKMWEEERNSYNSSSNSSSNLLLLLLFLVPDINYYFVSSGLATCSTFRE

SEQ ID NO: 26622 - protein, 76 aa, Candida albicans
RRNFKAGYIKRFLRQFSAYIGLFSIIRVVVIQILIYELVSKLETEILLQYPLNIYLTNWIQIIRGQGMTLKLNIIY

SEQ ID NO: 26623 - protein, 60 aa, Candida albicans
STLYFEQDTQELNTVKTQTSFLTAKAPKLVKPAHKSYIQVILSNHYKPYNRQQFKTNCTQ

SEQ ID NO: 26624 - protein, 179 aa, Candida albicans
GEGNSSSRRDNNNNEVYEGPTDEVDSEYANEELLEEVGALENYNFNDLLENKSANKFLRSEQKIKHKNRPIHQRMDNSSMISEWNRLGHQQQHMPADYPYQWSSNVANLAKTSKINRRRERLHRLQGASIDNKKQFELGLHGSPESKAKSANLVKLAKSIGLNEVFDLITLDAQQKLFG

SEQ ID NO: 26625 - protein, 68 aa, Candida albicans
CQWTCMYKPKVQLLTALQVLIFLCQFYGFVLSPFFYPSNYMKHAQVVTFKNVNWITRAFNHHSSPLLK

SEQ ID NO: 26626 - protein, 70 aa, Candida albicans
AAAAAAASATGGANGNLQYDTPGCPPSGVANVVAGSPEFSLIASHPSYGGIANYMYYPNEPEMNINDKKV

SEQ ID NO: 26627 - protein, 64 aa, Candida albicans
LAIPPYEGCEAIRENSGLPATTFATPEGGQPGVSYCKFPLAPPVADAAAAAAAYAAAAAAAVAR

SEQ ID NO: 26628 - protein, 67 aa, Candida albicans
FRRWSVNLPNSHISSDIHKSIMEVYFRVMCLAELVTLGIGVIVVTWFVVSVVANYCLSENWFSYSKS

SEQ ID NO: 26629 - protein, 88 aa, Candida albicans
QLLYVDLLKVITIESRAHAGYQRSINEQLNRQTSSISRHVNSTSTTFDSHTKTAFFVVASPIIRLPQSPSVRIINICLGFKTVLVWSL

SEQ ID NO: 26630 - protein, 392 aa, Candida albicans
SFPKNQSSRKPDLFLDTSSTISEDNSSFRKVITGHLLNEMNTPRKSSMSSPMSATFHSLFHRSHHNGSNFQRDTNQVATGTTPLSGKFDDFSKPSKTTLCLSSNSSNSIISNPELAQIYNFANPNISIEDGETNLDHSNSSFLDIHKKMLVPADLFIQNKLNKYYQTEVGLDIYESELDRDKDNKIYSNLYHYLKPLFTPSFSISDSGQQGRMRPILGASVEEIANFVKESFYLHQHNHDKSFRLKTRSSVSSLGRDKVEDFDYLQLSNLFEKLMSLLSHNLQTTEPSEVSLQALILNAWKYYNTYVRFYLLSIFQPLQIYLNELFTRNHNGSKIIRIDDLLLVSFRKVFITEQGIGSGDRETSQFLGNAESEDLTGNGLLTSTLAVLSSIS

SEQ ID NO: 26631 - protein, 64 aa, Candida albicans
CLHPRVLIYSVLFSLVEGKKFASSRKGRARGIVDRQRLLVNHMCYKDQTRAVLKLQLCRVLGVN

SEQ ID NO: 26632 - protein, 61 aa, Candida albicans
SSNISVHPSSSDDDSSPKTLREFTSPSESSKSVSGNGLRIAKKLKFPQESKQSETRFVFGY

SEQ ID NO: 26633 - protein, 74 aa, Candida albicans
  UNSURE (36),(37),(48),(53),(55),(59): Identity of amino acid sequences at the above locations are unknown.
ESLVKLAVAKPRTERGALKAVLEADNIVFECLRNYXXEKKRIENDRIXFSLKXRXNFDXIGWGWEVLNNFNFFL

SEQ ID NO: 26634 - protein, 89 aa, Candida albicans
  UNSURE (78): Identity of amino acid sequences at the above locations are unknown.
KEKKRINPNIVYYSFCKTLNRDSNIDKTKMLKIMEFYILLRNVITYFLSPVPEKKCIHEWMCIKPWNEVHDFYLKDVXPFPITKTLKNA

SEQ ID NO: 26635 - protein, 69 aa, Candida albicans
IRVRNISEFLLLVELVVSTEFAYKNCVQWKLLIGKEKSLLNMSLNKSLPTYQPIKSKNNRHSYFAIQSQ

SEQ ID NO: 26636 - protein, 126 aa, Candida albicans
ESTFRNPVSQFSILLTLYTQFELLFIQELTQPIAKPIHPVFSQLVQQKGMRKRVISTMFHDICRPSLPRKRLASSIGLERETFITRVISRLRVRVPRWAFFFTSLRQLWVFFARCSFYFITRPRSF

SEQ ID NO: 26637 - protein, 79 aa, Candida albicans
NVSILVLAYKCIHHFIFVNEARLYFFFCLQKRGNFFFLWSKVVMTPANYYKFTRLNWLKSQLGRTCPFYGSDFFGDFFN

SEQ ID NO: 26638 - protein, 88 aa, Candida albicans
IVNDNEEFTNNPKAYKSFRLSIVFCGYQYWYGFLTSFMETDDFAGFIYDGGAISYGISHEIIFLQLNFVSPLFSLIHDHCMWLEKKFP

SEQ ID NO: 26639 - protein, 580 aa, Candida albicans
YPQKTMLKRKLLYALGLLVNSSLSLTIHSTSSSSIASPSVAHPLDDNTYFYPRPTPISNCELTFSTDEYTTTVTFSDGCPTGSVAPPPNFPPTVPYGCTYFASKTYCPYNCDTSTVHYYDYIYSVTSCPEQLCIFDKSGGRPSFKCEPTTLSEPWSSYILSDVSSEVSVTSIVDSVSQDNSTWHDNNSNQNAEVTESNNDDTTEHHPEPTHPMTTQMPVTCEVTQTHSHGHSWNDVSCNYLPIECTKTTTFNVHNQTLTYIWCSSTTIELFPSGETTTTFCPYDTCYDYLHHTENNRNTRVDQGGLEGNTGTGTTVAPAAPASTTNAGTAIITKVATFIDTNCDETKTLNDKAEGGHGHAGSTANGDQKTIATENIPIYKTIDGTNTDCIIITTCPTPVTLTVTQEITKTETVTAYNTITINDDGDICIVTTTTNEAKTTEPSYENQVTITTHAVEDGFNQEYSSKPNQPNTTSEHGTEKATTTETPESSNQKPDDKSETSNDEPVDESVDKPGYEVTDKPKDEPIYKPTGKPDKESVDKPTDKPTHSFEPITSTIGNYSIDYSSTMWRNSSTLATTVVK

SEQ ID NO: 26640 - protein, 153 aa, Candida albicans
  UNSURE (121),(141),(142),(144): Identity of amino acid sequences at the above locations are unknown.
TKDNTAKGFQRVLSDSIIYDTTMSGDLHNDLHQIELTAHALLSGSLDNLNENFELLNQSQLILLTRLKIIEERLSNFKSIINDNTINEKELEEQFNKIKQLRKRLDRCLKMTESIEMRVDXLENQEYRIHASFFFHLYVYXXVXKGSVALTVL

SEQ ID NO: 26641 - protein, 89 aa, Candida albicans
ITMVIIKRNSVIWNLKVECLWLKLKLNVNSVTINEKAIELNLACEVFFFFLHCFNPTLNEGHNNKDRQKTIQQKDFNAYFLIPLSTILP

SEQ ID NO: 26642 - protein, 73 aa, Candida albicans
RSCIFRHNSHILKIMHTSLKCVNIPNIINYMCSELVAKLSTQFTLYKPYNFSTFLYFFILAFLLESINTFFII

SEQ ID NO: 26643 - protein, 138 aa, Candida albicans
NQSILFLSFRYIFHLLIDYLSIYQNTTQSRAKKDIRRNFTEMQSLRIIQDLFLLWLVFGDCYVWFFFSGTQATKFFNCYVTHLLSHSLTGTQRTKQSSGVNFWSLRCKSCKAIGTSTKMVPVKIVFYSTSIIKQYLMM

SEQ ID NO: 26644 - protein, 252 aa, Candida albicans
KEVFLIQRKQIYKYHNHSHSHGRHHRMDSQGYEKRKMNHQSTMSTSTTISSAAMNQQQQKQKQKQKQQPQKSVYSDSILKLNIFIQDSNNTTNNSSGSSSSSSSSSSSSSLLQSMISIKLRKDKLKNLDELINLIIYKLMKKLNRHDDDLIIDNIKLLIFFKNNNNNNNNNNNNNNNNSTSDTNYGGGGGGDDDKHVLINPIILKDKIDQSITKKKNKHQNSSSSLPINNYKDDLLLEYIQMKLKLYIKAII

SEQ ID NO: 26645 - protein, 67 aa, Candida albicans
HMWRIIMSGVFLSCYKLLIETCCNVCILNLYLIFFYSSCIGNKLQNVTLRPNVTKNDAKKKKLTSTK

SEQ ID NO: 26646 - protein, 80 aa, Candida albicans
IIKLINSSRFFNLSFRNLIDIIDCNNEEEEEEEDDDDDEPELLLVVLFESWIKIFNFNIESEYTDFWGCCFCFCFCFCCC

SEQ ID NO: 26647 - protein, 64 aa, Candida albicans
SFSLSALPIVMIKPKTKYATNQFSLRFSFSFSFGFGFSFSSFMKITSLVEFLFFLFYISSFNYI

SEQ ID NO: 26648 - protein, 190 aa, Candida albicans
SINQSINSLITTTITMYKFTVFIAAFFSLFFQSVIAAPIQQGFRGNVTLYIKSDSEEVNGKTLYTLTKDVGFNEIYIGDYVTPGATFYIEPNLIYQRYDDEKSRTSYALTYSEDGKIGVAAGSDGIYISDFDQKSGEIKFSGYDYLYAVHVVDKPAYSASQYAIQVGNPNLPPKNSYKVSIYGRLNWAVL

SEQ ID NO: 26649 - protein, 88 aa, Candida albicans
YYRIMGLLTMGKTIDEAAYLFMLMEKTCHAQLLADAAESKDKPKQYIADSEAEYTARITSNPAILYTVFQSDYKLEERLSNGDFKFAG

SEQ ID NO: 26650 - protein, 60 aa, Candida albicans
VSLMKRYDNLVRPSPRISKTSSGLTLSWKGILIGYKILEVYIKGRNIKTQSNQTSVYDCI

SEQ ID NO: 26651 - protein, 68 aa, Candida albicans
ADVNTPDSLEDDNDDPIDEESNSLINLLASSMFKPYQNKIWPFLANEPSDLEKYQGKLASFSLTTQHN

SEQ ID NO: 26652 - protein, 61 aa, Candida albicans
KKISFIIAIIKLNINLIKKSNYFWKKFSLPRCKISVHVTSPICVLFFFLSKQKQYELVLMV

SEQ ID NO: 26653 - protein, 87 aa, Candida albicans
FRLHHPRNLSNSIMYPDRRRGSRVAEKVYDETLALSDYFLVAGHDMWVVDCWALYLVSHPPFHIQRWIASQCMCHSHRPGLGCCCRR

SEQ ID NO: 26654 - protein, 92 aa, Candida albicans
DVLSNIQGGETKLQVQAYQRRAWVFFYPVVVQETTVEWVLGDTSHHQHDGAQPRRVYDWVDRGAREAGVVYVVQEGRGTVERSRQAQCKRGS

SEQ ID NO: 26655 - protein, 67 aa, Candida albicans
PATARRYHGKQLLWLAVKKLFKKLDKRGKLNSRVGLRIRRGKFYLTRKNTIKTTLQNNLRKNCFREE

SEQ ID NO: 26656 - protein, 271 aa, Candida albicans
YRKTTNLGEEHGMINNLVKVFNKYELSPTQREVVIDLIFMINIHDSYHDFIKVLTLDYFDSENKKYLHVLRNTIGPTTRILQFDDEELISMLSTYLVIHGSEQFTQSDFLFIGSVLENIHCRLKLKDDDDEEEEEEFDAKDYEDDSKLNLNSASNTTTVYINDKISDSLDKLYSPVFIQGTIDLLKNESSELKNLALKILPALINLYPALKGKICMLLSIVPNCYKWFFETIKEHELFQLFINCNKDYVKTQELENIDKFFTTGWNINACV

SEQ ID NO: 26657 - protein, 64 aa, Candida albicans
LCKIYCQFVLLDHAGCPMIVVRGIIVVTRTLYGIFFNRKLSQGIKSINTQDLLLSLMKFEQIWT

SEQ ID NO: 26658 - protein, 90 aa, Candida albicans
LEMFRLISRITRSCQSYPRQTHFRLFHSPTRLKFNQIVDNFLQDLKQDEQENSGGNKNNGKKSGSGKDSNDRFEQFKTCLHPRRLESQRQ

SEQ ID NO: 26659 - protein, 457 aa, Candida albicans
LTWIHQIVVFCFCFFIVGFLSICYSKIMKVSTLIIVSIPIVLGLQIKDTVGTTTENTFWYQLFGTPSRSQPAAVAATAAGTEVQGFTPISTSSSSSSSSAAPWYQGLFGVGRTTLGQVTTPSRTSTTTTTSNPIAPTTSIANSNNLFGTDTAPTTTTTTNARSRSRSTPVTVSGDNVLTLFGNPNLSTGNDQSNSVSKTTAETTTTSLAPSSSSRVQPTVINGGGSDGVLTLFGNSEALSNFDSTTVVDSDSTARITPIASASASSGSSTKDNDSDSSSARGIKSIPNSSEFLASLINGLGSGGGGNGSGSNTNSYKNHSTTSTTSKYFNSSSTATKLSSSKSIYSNSTTSRSSLSVSSSSTDGGGGANLFGLLLNSVAAVSRTLAAESTLSTGTTTTSDSANSNTKDYSSYSGTITSFPSTTGSLSGDGNKLIGGNKYLISFMWTNLILTMIMLFT

SEQ ID NO: 26660 - protein, 93 aa, Candida albicans
  UNSURE (29),(77),(79): Identity of amino acid sequences at the above locations are unknown.
REICVYVWYSAGDSDAISNEIWQSGLDIXVEKRILRSNTAELGMDIFQCGEEVREKKGERERENLGEGKEGGREKPXYXNKRILLLCGGRRAF

SEQ ID NO: 26661 - protein, 64 aa, Candida albicans
LIRSRKARVKKKKILLINRKMKLNKCYTWFPLTIFYITTIDLLYSKITLIINLNFVIKFYLLGG

SEQ ID NO: 26662 - protein, 87 aa, Candida albicans
FAYIRKKKGQVNQNKILDRWDGSIHRRTRWDSSFKGGEGEGHDKTFIRRHFEEQSARDLYQLFKIILYNFPLLTMYIQTIYTTCIIF

SEQ ID NO: 26663 - protein, 697 aa, Candida albicans
YCFVVFFVNIHICIQIWFYNHSNSKLNPYSQHKHRSIHKVTQEMLAWLRHRITSYNTSTYSSILPSALFGKVYKIGTKLNFTLLALCLLLACSVFFNYFYLADNNGLDIDTKGEEEENVFKDRKMVIFPNNFEITDKNLLEYYLKTLEEPLHPQDTIYRNRFIYKVPDVSYTSQTINLFSGLSQNSQSSKCEDLSSSYSFDVSGPQNKNCDLYKVLGKFLNDNSEYFQEISPLFPKLKEMLVKKEIEKHWFQLIGSSVWLEQYGVHLMTSRIFYSSTGDKVKPVVSLTYVQVFDHEWREIENVELIVPDGEGKYKPMTYPTFLPMSVYHNEKQQQGRFYGVEDPRITLVRNKLGYDEPIIVYNSHHRKITDAKSDNDGESNIHFKAYRSIFMAWLWQNQKGKNNVEEIETGKMKNRVYVKSKELIKPNNKREDKEKNWAPFINYQQRLQQGFDSHVYFMYQFQDLKILKCSLLDEEDCVWEYQFNDKNGAGRLRGGTELVNINQLLTTFDHPEIKRVKDLMPQNREIWIGVARAALEKCGCGDKMYRPNIVILIKDGDDQYRLSHVSPFVGLGILILPWWPDKGLCDGKNLIIPNGISSWHLNKDEDNSVQDYLTLSISRADSTVDLLHIKGLLKSILFDDPNLKLLQLNDYGFNNKNIECAVKSSDAFCKKYGSEYKLNNNKEEDKANGNGKGSSS

SEQ ID NO: 26664 - protein, 65 aa, Candida albicans
  UNSURE (45): Identity of amino acid sequences at the above locations are unknown.
KTRLNYRKIILLVYIPSKSGKLIKPQLKILKIKHPPKKNEMYPPXSPLYFIILHFPPSTHSGIPF

SEQ ID NO: 26665 - protein, 67 aa, Candida albicans
RTLTHDCLLGVWDIQIMFDLENSPPRNKKFAEKKKNSQKEVCVAQKADAVATKRYTPNFRGPGCRSK

SEQ ID NO: 26666 - protein, 79 aa, Candida albicans
ILSTTSINTTTSLVFFQGIALWWLSICYKPTYFTVFKFNLIQIVSNYIIIGLSIFLYKSNFNNYNDRSFINVLFNTSII

SEQ ID NO: 26667 - protein, 77 aa, Candida albicans
GADLFSIEELFVTTPPSKKYKLKKNLNCSYNIIGINVMGLYLAFEIELLGYILFAFKFVVLADMYRSSAILEWSVFL

SEQ ID NO: 26668 - protein, 73 aa, Candida albicans
VKSFHRNNSYKLKMTFLQYSLKSCLVFLSSSQAYFDLLINYSQPKQYKLNKYFPAIALSLSQVHSRHFLHFQI

SEQ ID NO: 26669 - protein, 101 aa, Candida albicans
SKDQSMLEKKKGKPNKTLMNIEGMSSSIYMNCFDENFSLRVLLFNFRSHLVLSLSIIKNISRLFLQILIIFACLIFYCMIFEIFIIKHRNSTNLSLVALLL

SEQ ID NO: 26670 - protein, 114 aa, Candida albicans
SCGSNMIANSTNISNRMFRSQRIIILSILAAFLVLLGITSLSGHHQVVVNSVKSMSNKASDSISEFYNKVDSSLSSDEKELIEEGKADAEKLAELADEKLKEIKEEENSNPQQK

SEQ ID NO: 26671 - protein, 60 aa, Candida albicans
LTKRITKKQTTFYCLSLILRYLCISCMYGVIIHYSVKLIIAIFFFDSKDHDPNSTVVTHK

SEQ ID NO: 26672 - protein, 61 aa, Candida albicans
CHNKNQFKLLQVLAHEISSLNFIKLAALKNCHKFSLQTKGWICSRTFVQMINNYIWFIRFD

SEQ ID NO: 26673 - protein, 87 aa, Candida albicans
NKSANASFFGGTIVHRNDNKLSIYLVLKTEKDSKKKEKKDTSKYKTENVHANVPRRPGDLSLSVFFFSIFPVEEVVHAFLSRSCDKV

SEQ ID NO: 26674 - protein, 75 aa, Candida albicans
AFLKEYYTFSVEFGKQISFSQRIAHGSSQARKKNKQNKMESFKTTITTTLSFYIEIVLIQWKILTNRRITRDCQE

SEQ ID NO: 26675 - protein, 62 aa, Candida albicans
KRNRENQSTTVFELQNTIMHAYSYRVLLYILFLFKCLPALIQSDKDSITYQPQFPIVLGLGC

SEQ ID NO: 26676 - protein, 112 aa, Candida albicans
AVATINQNIKPWLWLGSIGYGVGDKRILDTRKRDQLPHAIGIKFYIESQPVSSQPFDISVFIEIVAFGKAKVSNKGHHNPRCGTVCGPLRIEGENSQYCIRRIDVNNCRLVS

SEQ ID NO: 26677 - protein, 87 aa, Candida albicans
SFIFIGILAHLRLECFPVLSKSNYTLSQDLERKACTTSSTGKIEKKKTERERSPGLRGTFACTFSVLYLLVSFFSFFFESFSVFKTR

SEQ ID NO: 26678 - protein, 65 aa, Candida albicans
IANLNYLLKLDYREKYFEHCLVILRERTLDNTLIRHPISQVFANLLILHEYKNTLNYKITSPAPK

SEQ ID NO: 26679 - protein, 67 aa, Candida albicans
AFRVNLQIIEPVYYTIKSHHHHKKNFSFFLPISLESKKKIRESNFYTTNQPNQINTLQKIIQELIAY

SEQ ID NO: 26680 - protein, 60 aa, Candida albicans
HKGGDMPTNYHFAEQPRNKNTHVQVPEQFPFGHIEKQWLNSIVHQNCKLKILHFIQGLEE

SEQ ID NO: 26681 - protein, 498 aa, Candida albicans
QFLVVKLSKRSSETLDIDIKGEICRPTTTLPNNHVTKILTFKFQNNFHLVILRSNGSIQLYTKTANSKYYTLFKDWKNNLMNSHTDMIVALDVLNNQYLYSCSRDGKLIIRDLINDDADKSYEVFMLMDGIGKIDLKLDKFTNTISVATCGKNSDLRLYTIDLELDNASKGNSKDPDQSDWTYVQSFRNRPLRRSFTTLSLEAPFLSAVIPPPRNTERRHSKVLTPYWQSITPLYEYVYNLDPTDQISQWMSSVCFVKGNDYIICGSQMGELIIYNPVKDISPVFKKRISQFSIQNIEQIDSDLIIFSDSMSRIIIFLISKRKIVLQFLQLDFGPFLHLKYILPNAFRRKTNNQVVTFDDIYVLSTTIDQRLVVYKLTDSGSSELLLSAKILKGMIFSATLLQSVSEYDQFRNLFGGDDEGPSAPTIIKKRKLSSNSYALMTNNNGLGHSQKSKMSFIETQDNTLANTSSSSSQTESEDDNGESFEYTNVEKHKEATK

SEQ ID NO: 26682 - protein, 61 aa, Candida albicans
RDGKEKRKIFLVVVVTLYSIIYRFNYLQIDSESSNDRKYNNYKHNVVHFIVTTKNRVYINI

SEQ ID NO: 26683 - protein, 134 aa, Candida albicans
PQLCQHLEIGNVLQTEYAVDRGGGGGTAAGNDLSWYLSRILWFKVQRKLLQVVVLAVLEPVGGELAVDKQMSQSRQVYQQIAKDVHVPLSIRIAVDYPKLGHQVSMLFEETRPPVYFAPHIAPAGTDPRKNNSF

SEQ ID NO: 26684 - protein, 66 aa, Candida albicans
VCLHILFLHQLINAYRLSYANEFHIGNTKNRKQFMQGTFRLRIVPKVKYFMKNNNLIMSNKYISHS

SEQ ID NO: 26685 - protein, 84 aa, Candida albicans
PRSAVDVTLKYSSNPLVKGGSNESGLRISRIGGLLRMLFFKSSAMLRDTMDINWSQLRCMVGGVWCSWAVKLEMVLQTQGGTQM

SEQ ID NO: 26686 - protein, 97 aa, Candida albicans
SSTTYETTARGASVPERGASASAKGSQVQPGVDVAYSPHRHTRSHFSGFVKAGRDKPIDPRSQAQKRAKSYCFFADPCQLERYEERNRREDGFPQTT

SEQ ID NO: 26687 - protein, 85 aa, Candida albicans
TVQRVFAIWKRRRLFKFGGAYGHCGERESQQQRDVTVHEHWQLSETKSIAGSCKGRRIQPIALVWKVADKQYVAGTRHAGGLRSS

SEQ ID NO: 26688 - protein, 168 aa, Candida albicans
TIKAQGCEIYTRIDSTNKHPNQSEKKKKYNTNQKKNKRTTYKTHLYHNTNVLGATPFRVDMHGQHGDMLGTGARVLQYCTAPVTHIQGCQVQSRAPSSQHHPHSTTRLPHWIHRRPGYVQHNHSHIRYRCATTINTTSAREQLRRQYVYERRHAQHQAMLAGHHAVRL

SEQ ID NO: 26689 - protein, 254 aa, Candida albicans
TLLINIQTRVKKKKNTTQTRKKTNEPLTRPISTTTPMYWVLLLFVSICMANTETCLVRVPEYYNIVLHPSPISRDARFSRELHRLNTTHTVLLDYPIGSIDDQDMSNIITVTYDTVAQPRSTLLVRVNNYGDNTFTNGDMLNIKLCWPATMPYDFSIDHVYMHSNELVESVEDEFDLYVAVTYEFHAFSYDNGRFLQEETALSFQLYVNKLPSRFLPIPLELYDTIVYLVDITIFIVWNILPYLVKGVLEAVGQ

SEQ ID NO: 26690 - protein, 112 aa, Candida albicans
RVLLVCHTTTQVLEMSIARYIYYTIAVAVLLNFVKATENNNFKLELEASWSNIDFLPSFIEAIVGFNDSLYEQTIETIFGLGDTEVELEDDASDQEIYSTVINSLRLTDQDL

SEQ ID NO: 26691 - protein, 112 aa, Candida albicans
CCCDKIKEHDPFQENGLEEEGVNQCVMNTTLALSTLYKNIKIDLNFSSSKEFKYFPNRDNLQYLITSLLFKSSMMMTMIIVIVLFFFFLNVLFLEMRLDNNNKDGLLHPKEI

SEQ ID NO: 26692 - protein, 617 aa, Candida albicans
INLIITSIIVIFIYWLPLVIPVVEILPLSKTLDNKYGIFGSCLTSNSDNCIVVNPLDFTGSIKDNLSGYLFMNDTRTTLAKIFVLAPIALGFDLILLIVIFVIHFGSRVTVLIGIFVNVLATIATIITCVVVILCFYPYVTWVPWTLVAAGAITFISLILLILSLTVVGNDDDDDDNDAKSNFDNEDFGRFTNYSRIDDKFNHIQTSTFKTSNSLDNDYEYKPHNNNNNNNNATTATTTNNVGSTNFTGGAMNKFSNPTNNSRGVMNGGSTTTGSGVGSGGTVISGMNPPAHKNGSLTSNSSSYYNNPQTATDFTQRNKPNAYQPSSLSGSGSNNGNTASSSLPYPPGTPIVDNNSNNSRNNYQPGVFDHHLGVEGHKPFTELDDDFDDDDEEEDLANNRREIVNINDSDNDSDFTSVSQRPPNPQYYGSNSGSGTGYLPSNVVNQYCHVQQYQPIHQQGMPPPPQPPQQQQYRPTGQYSPSPNMGYNNTPMRSGGGVPPPGAGPGPGPVPVSGSYFPNQGPVPVPPQQQQQVRGPTISENVLNNNPDFQFSRGGQQQKRRVNPGFVPVAARYNNNNNNSTTGSLIGGPGNKNQNASALMGRRENTGPRSGPYGITR

SEQ ID NO: 26693 - protein, 110 aa, Candida albicans
IENNSNNDNSGDNNNNKLLVVKPNWNNLRLRHGVVEIEKHKALTKVNKKSNNKKIKKTSNQSGNGTVTKVTAGLPPGVGTSLITVTATAAKVRTLVIVVTTTIIAVSVGV

SEQ ID NO: 26694 - protein, 63 aa, Candida albicans
SLYKIYNFIFLGYNRANNTAFHAISDLSTAKQILMTTTKSCDQSCEQGSDGKKRKRNQIHKEK

SEQ ID NO: 26695 - protein, 121 aa, Candida albicans
IMSDISKQMNNLSVNDGANTVNNNNSFRGGRSQYVPPHLRNRQGGGNQSGSSSESSDVPFGGSQRGGFNSNGFNNNRSGFNNGGYNNNRGGINNGGFNNRGNWQPILWRQRWQRWFQQRWR

SEQ ID NO: 26696 - protein, 64 aa, Candida albicans
  UNSURE (64): Identity of amino acid sequences at the above locations are unknown.
TKFFPTVVEDADRDFIARINSLIAQVLEFKDDEKSCDINQVVSEFVSPTKFATVLTTPVEGSSX

SEQ ID NO: 26697 - protein, 114 aa, Candida albicans
QLYLETDNPTTIKYRKKIIRIATKLWVLIDSTMVITTKKKEVEKIKFERYGNRTRVLSLEGSYVTTTSTVQLTSCCTTAVTVAFGNLQHYYIQQVQVNNCISLLDTTVLLNVNN

SEQ ID NO: 26698 - protein, 76 aa, Candida albicans
KQSKELSLDLNDIDGTLKEISKNSSRLSCEYDTQDPYNKKPEFSRVEEVVISEYNSDDLYQGSEFSTNDEDSGDDD

SEQ ID NO: 26699 - protein, 393 aa, Candida albicans
IKFNNEYTNHLIKMITRSRHISKRLYSTNYLAILFNAQENVNQLLESQDRSSYILAQYIPEPVRNTYLAIRAFNLEINKINEGGSNVQSRAARASSQMSNTLGVSTADLKFKFWSDLILRVFTEDSRNETDLGEPIAILLRDGLKHDFNLNISYFQQFLQTRRHFIKNNSSFQTVNDICSYGEGTFSQLNYLTQGLLLSPSISPSVIRLLEYSTELQSQMSDIAAHIGQATAVSSMILGVPFYAQSRNQITLPVDLMTSSGLSQESLLRLFQGHIKDSAEENQIKEALKNVVYETAITANDHMLTAKSKLEMARQEIKKIVQEQPQDQLLNKFSKKWRKGIPDSLYVPTMAGIPTSLFLNKLEKCNFDLFHGRLQKEWRLPMKSFYYYYMRLM

SEQ ID NO: 26700 - protein, 82 aa, Candida albicans
YILLLNTRSEYNGKSSKNETIKGDAIHTQRDTHNQTSFYQKIQLFRFIKIMLSSMKENEYKIVADTVDNDDYVFFVWNLFIF

SEQ ID NO: 26701 - protein, 78 aa, Candida albicans
IDIFITIEIDDIPIKQGYSDNLSKKGKNQGSGRKKKKFPCQTCSLNRSATFCDASFSSLPPSISPSSSPLSSDKVFIE

SEQ ID NO: 26702 - protein, 68 aa, Candida albicans
SIQYELVLLSSINQSPGASKYRSGATMCKKNVTLHTNWLHEKKKKKFFTFDSFDPLHPFPPPLLTIYN

SEQ ID NO: 26703 - protein, 65 aa, Candida albicans
DLPPPYPGALTARPSSHVRRANCGKLFTTRPNNSFHVETINPLIYIGLIIQNPHYHLRLVLLIYI

SEQ ID NO: 26704 - protein, 61 aa, Candida albicans
FRPRLCLSFYAWAPSIPASLSTMPEITYDVIYMSTSSSPSIYASLRPSTLVVINFFSGYHT

SEQ ID NO: 26705 - protein, 63 aa, Candida albicans
KQDNENQEKKNTKDIPINNGNCSPFILISTTPTTNVMKQQKRNTKDTQLVAARTRLSFFRRRE

SEQ ID NO: 26706 - protein, 62 aa, Candida albicans
RSNILSADELALINGGGEDAEKVDDGDDGEVAMLLLLILLLLLLILLVTAMIIYQLLLSKYK

SEQ ID NO: 26707 - protein, 664 aa, Candida albicans
GVALVYIVFSIFDYLAYLLLDFAYLIYHIDCLCAPIESESTDLNFALNTMALSEESIPKLYPSSTPLSNGNDRNPTVIQATSTPPPPPPPPALPDISTSTPIETPWYYKRSTGSESEEEEEDTNNGNDDYDDYYQDDGETIQKTPSPNKLKGYRFNNQLDFASTPLNPSCTLSFSSPMNKLNQLHLESQLDMDGFEEEHLIEQGEEEEEDDDDDDEYSLGNKTITTHESESESEQGESNEINIKHFEPKYISSRRKRLHLESPDMMVLTPNVNYKNNVNDKNDVNDITYGNDMSICNTTSTTTNTTATNTSAFKFSFSNISDSTPCPRQPKRKRLKFKHELTRNILDLNYAKKSILSQPLSFPLYNDGGEGELPNEKYCYDNDDENNSGISSGSTDNKSINSKLESTPISQSTPASLRASSPPPLQQQQQQKPRAQPQPQPQQTSSSSSSKSGQEYGETINGYKFVKPKNSMNNTKLPQFKYETPINNNRYHQLCQGYNSNNYQIMNELPVTAAGLMPHGDEDDDDIHIGDRRIGDPYLNLLRDDDNHCDQETHDDGNQLREIYFKENRLPLPTPYFYQLKSLSVDQILALINYENLLKFYETILNGDETLYELLKQERIRWHPDKWIGKLNQKNEMIMDVDYELTIKMVDSISQTINSIIESL

SEQ ID NO: 26708 - protein, 68 aa, Candida albicans
KNGIYEMNYYFFMNFIKIKNTKYKVQNEKDYYIELCLAILLEYLLLFLPLHHFPKRHFLHIRAGRSRA

SEQ ID NO: 26709 - protein, 78 aa, Candida albicans
FQASLINWLVWMEPMHRKTSTTSDGITNINYFSVEKLRWLVCWREYLKLIQSAKLYPNSFLINCYSCITDLMLLTTIN

SEQ ID NO: 26710 - protein, 73 aa, Candida albicans
KSLHLHPLKYQTYDVHLPIFDSVHDYSASSKVLGKRMVQIQKTLLQTRLAQNAKASKSYFSCFQLSFLFMCRH

SEQ ID NO: 26711 - protein, 88 aa, Candida albicans
QLLYIYLFQVITIESKAHAGYQRSIIEQLNRQTSSIYRHVNSMRTTFNSHTKTAFFVVASPIIRLPQSPSVRIINICLGFKTVLVWSL

SEQ ID NO: 26712 - protein, 70 aa, Candida albicans
IKKYKKRRIIYLLFYKISLLKRLTKSSSSGNRMVNLGAIHYYCLEYYWSIIMRKRNQINNQKMKIRIKKA

SEQ ID NO: 26713 - protein, 515 aa, Candida albicans
YYTMSEVPNQESPSSSILKQSNASTSTKIHGAPSSSQIANVDFNTLRKLNTNTSFSSNLTNSTTKTSNALSRLFTRNKSSSNISIHPSSSDDDSLPKTLRESTSPSESSKSVSGNKLRIAKKLKFPKNQSSRKPDMFLDTSSTISEDSSSFRKVIIGNLLNEMTKSRKSSMSSPMSTTFHSLFHRSHHNGSNLQRDTNQIATGTTPLSGKFDDFSKPSKTTLCLSSNSSNSIISNPELAQIYNFTNPNISIEDGETNLDHSNSSFLDIHKKMLVPADLFIQNKLNKYHQTEVGLGIYESELDHDKDSKIYSNFYHYLKPLFTPSFSISDSGQKGRMRPILGASVEEIANFVKESFCLHQPNHERSFRLKTRSSVSSLGREKVEDFDCRQLSNLFEKLMALLSHNLQTAEPLEISLQALILNAWKYYNAYVRFYLLSIFQPLQIYLNELFTRNHNGSKITRIDDLLLASFRKVFITEQGIGSGDRETSKFLGNAESEDLTGNGLLTSTLAVLSSIS

SEQ ID NO: 26714 - protein, 91 aa, Candida albicans
  UNSURE (89): Identity of amino acid sequences at the above locations are unknown.
SPMLKLLSQFEDLSSSQSVTEVLFNNLHQEVILSNCQMKTNKKDAKTQNKIKNMQKCKTNLKKTKQYKTNYKQIQYKILKIEKRSKTIXKK

SEQ ID NO: 26715 - protein, 60 aa, Candida albicans
KKTRSEKKCENLLNKKETEKEKVNEHQRQEEKKNSNNRNKHQQTLTSATSRRPIYINQSH

SEQ ID NO: 26716 - protein, 71 aa, Candida albicans
CGCKLKATDKFGKHFLKRIAASRVKKKNKANILVLIIVVIQNKVSKFSLKTSSHCLYRMNYSINRQKKAII

SEQ ID NO: 26717 - protein, 130 aa, Candida albicans
  UNSURE (87): Identity of amino acid sequences at the above locations are unknown.
SNFLVAKLSGKPGGKLVKLKAELNRTKVFNQHDSISPKNSIMKFFFILLLLHEKLIENQFQNILHYTLYILHLNYSKTKEILCNRKXVRQSIPSPPLLFLLLWLMLHKMKHTTTTTTTSITTIIIITLQS

SEQ ID NO: 26718 - protein, 83 aa, Candida albicans
NKWSLGVLGLLKLFILTGPRETILEDETVLTEFKDEVDWVENVLRAAGGCSMVLDLLILRYNEWFYLVSISSICSKKKKKRKI

SEQ ID NO: 26719 - protein, 120 aa, Candida albicans
HSESYTPHSLIRVTYLNDDNEWVVGVFAYKYRFRLFMTWLLIWLSYIVEKLCTCNYQIVVNYIKLTVKAFSDDLWNHNELEVAYLRMGQTFWIASFYKFINCALHTEQFLLILSYLDLDL

SEQ ID NO: 26720 - protein, 79 aa, Candida albicans
SCYFCYINFHFRKFTEFLARLVVPIRINLINQNSLLNSPSPSPFFLAVAFFRGYFLRFCYLFLYNNYGCCYQLITTVKS

SEQ ID NO: 26721 - protein, 72 aa, Candida albicans
IEIMEIIRKTPMTKWSNNKQWQINLFKNVIQLPLVLHWSLRDGCLTPFWVGLCGSGASWWNFKDMWLSIDLS

SEQ ID NO: 26722 - protein, 148 aa, Candida albicans
LKQKKRDTPIAKSNQQGTNSVIYIYINIYIYIYLYENCNTFFYSFVYFFLTAEVLVYFIVVSTPNLIYFFFCLYDKSIDSHMSLKFHQLAPDPQRPTQNGVKQPSLNDQCKTNGNCITFLNKLICHCLLLLHLVIGVFRIISIISIYK

SEQ ID NO: 26723 - protein, 66 aa, Candida albicans
LYFTPLCNYYDCKKIMTVVKQIVYFYIYFIVQTNCKLMYLLFSFLLCDLIGSTALQQMAHTSIQVI

SEQ ID NO: 26724 - protein, 67 aa, Candida albicans
VKYGWGGGKCGFLVYRSRHPSIVSNSLFRPLRLKKNSRRVWGQSRMIIVVEAHEHFVKPSIKYDILI

SEQ ID NO: 26725 - protein, 261 aa, Candida albicans
DLVTFCIKSILVVHLIMLRSFVTSISPIGYNAVSLVLMRALATKAATTTTKKSTTKASPKTKKTTKKSTKPPKVDTKAIRLQKKINEARSAKKNLQQQIKDISTQHKTLSKQRKFEEKARSKIHKLAPGNFYSMFQKKRAGDSVAEFYQFPEEEKAKWIAARDAYWEKAKSYFTPKPKLGANGFAKYVQENYIRGDSLTETMKKLADEWNALSETEKQQYQISKEDKEKYKKALEKWKELRLKEYSDYLKFKENYKVEDDF

SEQ ID NO: 26726 - protein, 180 aa, Candida albicans
TRSFFFFVFIFILPILQQLVIWTVQLQFFFYNIHINHRYLLLFMFKFKNKLKFGTSSSEKQQTPTTTTDTSTPSPAPASPSTSTSTQHSSTSVKDSPTPRQSTDSRNTISVNNLADDVSKLTVAADRSPEKSLGSNNKAGGEPPLSTTATDTTSNSSYRASPSSSQATSLLGTTSTGFDH

SEQ ID NO: 26727 - protein, 100 aa, Candida albicans
TRKKNTTTTTIQTNEIRERKCVCVLENLIRKERDKQILSKTQIRVRVLNFYPNFRPNSNLSSILPSCYQLAFFFFTPTLFFSFTPPSPQIYNMAFRGLTL

SEQ ID NO: 26728 - protein, 650 aa, Candida albicans
SLWCYQLSSNMTSLIYPTQSVSLSPNVISTTSSGIHLHQRTPSNPFEVIYDSQPVHKPSNTQWHNSQNYEEISKNIHHRTTSSGLPIKPAPSSSSPSPPPPILTVLDDPLFTKTTGSLISRLATLRNRNRIKRRNKTVKKADIKQNKPLKFPIRRKRSLQYKKRPQAPLFDNKKQMMDFLMNSNYQALVKNFIPQSMRIYLHHRILQPKPALTYSTKNFEIDELDNFVIVPTDKKSKTGSYLRGANLTAPVSNLSAGTGVGVGSGGGNTVVELIYQKYKEDIYTGGFSVPPPKFEELYPQDAKLLSSRELSDLNTKILFDILIRKTVAAKMGYRLKPAGNSFMGQHLTSLSSSFSSSSPSFSTQDSGNLSARTTPSARSRGLLPSSSYLSSHSTNMLETKPLFLGLTVSHNQKPQRDLRNEFINDFNKIYDQRYKHNTNNKPSFEKDLFASTVYQLSPINKSKSTLPSYDNEYTGRVGFGDNNNNKNNNNNTNSSTSNSKFDDEQTTTQPASSTQRKSTSTYTSTTSGLQNLDDFPINSYNIKPFNSFDVWQSKNIVPKDIISPEQLIDSLNKSDQFGYIRSRSIVEQNVAPRVESMQASVLTHHDSVRTKWSASVGIGGGTSQHDEKSQASPRFSQVSRLGSYKYQGVI

SEQ ID NO: 26729 - protein, 69 aa, Candida albicans
LDDQINKGRMHIFLVSVVDQMRRWLASRDVKILLRKTKQKNFATELASIEGKFGIQFLLTEKLKQPYNG

SEQ ID NO: 26730 - protein, 175 aa, Candida albicans
KFPLLTTITATKPPTTTQPPQEPQLHTFRPMQQSQQQLHQSFSAHPQQNQNHHQEVQMSIEIENALASAAKAASDSPSARANKDSTPYYLKDAKWFNKLLQLYDSGHIRADEVLCVCEGVRDNKIPLFMLNVLDHGYYPTRTPNNQPARAHSEEILDEETANRIRDFMLPMVYNS

SEQ ID NO: 26731 - protein, 407 aa, Candida albicans
CVFHRTRISRVFPAAWWTPTKRQQKLRQKQKLIQIREKRKRKSQKQKKASSRSQAPSQEHQLHQQQQQQVQTGNQEIANDQHHQQQQHQQQQQQQHFHNQGTGHNYALGFIQPTFDSQYPNKSPNVLASTDSLFPRLSSYDLKSKDSKYKRWTPRMDQLLIKLLSDVVHSYPRGAEPEMNKKAWLYVCKQLRYANPETVYSTYSKYSVLQHLSNVIQHRYKIWFQLMVHSKTITTGYSYKWNLTLGRFEIIDLITQSLILDSRQVKLILYGNTLSLPDLSQYNKSAIITNDFFLSDNLGYMSVYHNEILPVLAKLDSKYIEDIGIDGDIYTKVPKFDYPEGHNEYFKPLVPAKKPSNKRKIPEVFRQYLQNNGSHQYIEEQDQVGSSSTGMLQQFRRTLEEPIPLVF

SEQ ID NO: 26732 - protein, 139 aa, Candida albicans
SLNTKDLLLLHKHFHSLFVFATVSTPIFLKHSTEKIQQLQVLCMSLNIKLFLIPPHDLIVWILQVLRVEGPEKSTHFIDTDNPDGNFLSECGLSYFQVNQVLQRCSFNEFLVMDTKEKINQFREIVTSELIVCIIVTNI

SEQ ID NO: 26733 - protein, 491 aa, Candida albicans
KVGTLYQVSKIMFDYVLNKVILEHFKHLSQQLMPSCDLPTVLPVNFMTETLKINRSTSIALHDLIQIKPVRVSLSGPIPYELNAVKYTVKCENPISKSNTGFKNTIRRTHWYPDITINSTYNIKDLQLEFIESYLPPPCQSLQSEMKKWRHLNFKVDIPMIVNPSHKRLLIHPPPKWSLPDSIDLFDVSHDNLSSHIPKHSIPEREVLLIEDKSASSKYFCQHQFLFTPPQPCINRMRYHTWAYNDSSLATPCTENITQYLLDQNRVTESGKYLVLPVACPNIKMKNSPATTISQFIFSHLKLEKHNWKLPSHVLIENMSWNPFKVDVANFVDKYLMETITRKKSFMTTTDKTIISSVQMVLLPKTTATFPKISKIESSHELKPVNIKYSQKNNTPTKSDGLTNTQIQTNIATYHNDTDIMNELISSRKRKRKKLGTVSNVVLPPEISTLLFVEPKTPPQHNETTEDTQNCAELSISTNKSAFAATQHIIN

SEQ ID NO: 26734 - protein, 81 aa, Candida albicans
VLIFSGTKTVEQNPYNFFQPGFLSDWAQNPGYGVPKIIIQLWQLNQMPLPKPLRVTWGETLNGIGVIHVQGLLLGKGIKIS

SEQ ID NO: 26735 - protein, 84 aa, Candida albicans
VRYFPSRSDSFLLSNYNPYYMWTSTPFLCAFYSRVRVSLSHLVASFCCNCFRFQNENSLKLPGGPAHNQNIVNSQKNSRVQFPK

SEQ ID NO: 26736 - protein, 134 aa, Candida albicans
NVLPLECRMYIVNHILLIEFVNLRRFIVAITYSSLLLVTIHSHTKTSKKIQKNINSKKLKAETKKKPRENHSYSQDTNTNNKLSFYSSTATSFQTNITFYNSLTTLFDKKIALFWPTTTFYFVTLSLRLFPPII

SEQ ID NO: 26737 - protein, 104 aa, Candida albicans
INKNKESVYFTQSQNGLGEKRKKEKGTRNKNTNSHHHAPTQPTNQPTNYKERSKMKKRRKETQKQKKNSSFFFFASVLFYLDLYSFAVIKQVERRTMRGRKIVV

SEQ ID NO: 26738 - protein, 61 aa, Candida albicans
STIIIITQYCKVFVIEYLLLHYYTNKESLTLTNKSYTKKSVCYLSGDHLNNVVDPLIKVSI

SEQ ID NO: 26739 - protein, 83 aa, Candida albicans
GFSLDFNPPHLLAGDISCHFQGPEFRIGPTFRRRLTPRKKFLPSPLKLFLEELGEEHFNLKDFLKHLDDMLVPCYISPKGICR

SEQ ID NO: 26740 - protein, 97 aa, Candida albicans
LYPHFLGDLSFDFHNPSSQMSYLSSAFKGLVAGSIITPIVTKVFIVPLYFDSQIHKEIHYIQQEMEYVGWHIRHLEEEKGFQEEELYRPATYYGPVP

SEQ ID NO: 26741 - protein, 73 aa, Candida albicans
WGQTSMCSNVASELHWFLFTNETTHLFDAHSNNGVEKKNISDIFAKKKICPLTHNTLNNNPPNNNNVLGGIWS

SEQ ID NO: 26742 - protein, 61 aa, Candida albicans
DVVFHCVVKSTSWCEILPLFFIIRREQRAILVDTLFPTHIPIPILFKKLYYFWGVYVFILS

SEQ ID NO: 26743 - protein, 169 aa, Candida albicans
LWLPPLPLLFLELGNITLALIGTHLLVIGLMNFCDCGLLVGCSPNNGALSGAGHFLSSTDNSLTPAVTSPQTDFEGTGAGAKVFFEGLEGEGADSVVEKTLFDSLVESSSFVDSLVASFSTGSLDTDVDFEVGFDSEEAAGTEGDGEVPMAATLAYETGEVIWKSLNVV

SEQ ID NO: 26744 - protein, 72 aa, Candida albicans
SRYKSYKTLVPHSTINTLTTLCTNNTFMGLIVANQSSLKLRINLYSCSESSFIQITHTSAHRDIHLPHTGNL

SEQ ID NO: 26745 - protein, 68 aa, Candida albicans
  UNSURE (21): Identity of amino acid sequences at the above locations are unknown.
YCCLLLNHTLSILHIKNLESXRRKKKGTPVIIVLVGYLEIPIYCYRSSFFHYIYLYNSIYPSSIITNP

SEQ ID NO: 26746 - protein, 61 aa, Candida albicans
VKHSIFLRCPHSISIDYKYKALAIFGDICKKLYKILSEERKERKERENEVKFFYFSGFFIC

SEQ ID NO: 26747 - protein, 107 aa, Candida albicans
WENRELDCGQKGFFWSDGRVFDYLFGKETLQEAEAGIPYDKQFGIINQEVKKKKQQLREKHGVLWRYKMAAEEFGKDIKKLGGYITNSKSIDNKKKTDNGKQLPKGK

SEQ ID NO: 26748 - protein, 338 aa, Candida albicans
YTTSSTTITSSPFLTMLMLMPARFGYHIAKNSSSILRPISILRFKSNVPSAKQSKNNLPADGIPKKSLPSEGEWKHLKLHIPGENVETNDLKDRIPKFPLGKENVPTLLPRPGVPQVGKNFTFRQVIGILKNKTQPELIYESEPHRLYFLMCFCASIIFAIYGCVLFEWATWIANKEYDENEKEETNLAIRKREWAISLAMYLAPSAALFLLAYGAALFPTKLVRIIWYLPGPVEHIKFTSYPFIPGRPTPVYTVPLENLKRKHTSRVWTGKGFYGTADKGFFYYTLLKTLPNGKTENWIVDRKGSFGLMEEYLIIYLVKKLCKKQRRVFHMTNNLVL

SEQ ID NO: 26749 - protein, 318 aa, Candida albicans
NFIENSFFFYFYFFFFLQQTHSHTPIYTFFTMAAGLRQMKLHNKRKLNELEDISNIHKKSRTVSFKDENETKKPITRLNLNRKRSHFVTPPSPPQQRSSPPATCLEDDEPPHHQQDNDDISEQQQHHHHHHHHISFPATPPESINDESTTPIAAATNTNRNDDYKEYRDVNNMDVELFTANTGIIPNNSTNSSTTTVTTSSPNDGKSFKQDLNENPDYIALTSSLRMAKITNTKINQDIIELSKLQQYYSSTANKEETIQFFLKLINNELDLPKPTRITKCPIINWSKYHSCLSQVNKDFENQLHKCDKKGTGHEFIV

SEQ ID NO: 26750 - protein, 81 aa, Candida albicans
GCFNTDQFSLLTKYINLASQQELDDNNVPFFHRDKCAAHLINYYKCLDKGTSFCNKTKDEFYKCQYLALKERLDNHTKQTH

SEQ ID NO: 26751 - protein, 60 aa, Candida albicans
KNLKTTLTPTLVVPILVTYDSQKKKTLLENYISLNEWGCVLYVSLNSYFTNLVNVLKFAK

SEQ ID NO: 26752 - protein, 60 aa, Candida albicans
VFIFTLSSQYEVNISTHTLIMIFDSQQKKLWWCYFNNLILDEDPSLDLIPYGFLFNILCP

SEQ ID NO: 26753 - protein, 276 aa, Candida albicans
RIETSSINVPYLHSFLFIPSQMFKECIGCTQKRLDDEPQDDRSQVLCPICRMSRYYKAYKQYITSRMRSKSNLKSTSIERKLRKFITNKFHIITKLYALKQLTSSHKLKEYLQVKNFLLNDRQIKFIFSSKKAISSRLCLREIERLENSNEAQEELLQLEVTSTSSSSSSDTENNEAATEVSDKTGDLADEQPPQDREPNIDTHNKDTSPKVTENDNNEDVVMNDVDNNNKPHLIVSQNNEEHETGTNDTPLSANITLENPNTVATESGTPTVTKP

SEQ ID NO: 26754 - protein, 61 aa, Candida albicans
HVMSCYPEDSIYYICKLTTTTTTTANALKKITPNKKLAEMKKKIKTFIFSEFLFFFFCFRL

SEQ ID NO: 26755 - protein, 92 aa, Candida albicans
HPTFRVRARRKQLMDGVYQIRSIEFHPTTRFSECETTRTTQQRLKKKKKKNINKLITHTLETQYWITFFDNTTTTQLMHHSCPHVLLLKNVY

SEQ ID NO: 26756 - protein, 83 aa, Candida albicans
LIFMRKRNGCSHKRIFISDSLKRVVYVLAMQLTVETFIKTITQTPFKPFTGIQRARFDFHDNHNKLEKNQFPIQEILQMIFHK

SEQ ID NO: 26757 - protein, 66 aa, Candida albicans
EIRQPHNLPIWTTYPDNRRSIETNKSESYNVFMQNINFNAIPTIRIYNTLQNKIHFGYLLLFSFLQ

SEQ ID NO: 26758 - protein, 67 aa, Candida albicans
YECGCQLSSHRENHHQDKTINRVTNILQILQFNLGFFFFVLVQVFSTSSNKETSSSSPTPSLKNEVF

SEQ ID NO: 26759 - protein, 401 aa, Candida albicans
CYHYHQPVQLLTHLILNPKLPQLAHLLNQPVHLLYQPVQAVPSSLLLFTESTVETTTGPGFSTTVTLTPGTNVITSPTGPATEPTGPSTKPTGPGGSVVTVTVTKPTVQTITGSGYTTTVTLTSGTNVITTPTGPATEPTGPNTKPTGIESKTSPTGPVTTLTTSVPEQSVITITGPGFTTVFTLTPGTNVITSPTGTATKPTGTGSEATPTDPATKPSGSATGPSSPGGSVVTVTVTKPTVQTITGSGYTTTVTLTSGTNVITTPTGPATKPSESNTKTSPTGPNTKPSGTESNTKPSPTGPAGTVVTVTVTKPTSETITGPGYTSTVTYSEGTTVVTVPTGTPSTDKPNTSSAPIPSPSKSTGTGTGATTTTTDDGFPSGSGGVTWTPQPGWICQCVRV

SEQ ID NO: 26760 - protein, 90 aa, Candida albicans
KYVSLSLTEKKNNCGKSECQSKSEYNNDLQLQFILQQDNTQQQEQCRLILKQKITLLLSTNILKPVALCLTHLLIYAYTQQYTEFTNELS

SEQ ID NO: 26761 - protein, 60 aa, Candida albicans
VSGLFYFSNLKLGNGKSLLIVITKFQLDFFLWWFNSHFKMLQMKNSQITRLYIQQLVGNL

SEQ ID NO: 26762 - protein, 298 aa, Candida albicans
KMKFSNVAAATVLASTSSACILPIVEGLLNCVFPRPPPPTIPPSPCGGKKCPPPKPCTTRIPQTHTTIVISTYTTGVVTWGGSVTTVTLTPGTTVATIPPTTVTITPGTETVTLPTPTATVPNTKPGTDTATVPTGPNTTTGTSPTGSNTKPGTDTATVPTGPNTTPGTSPTGPNTKPGTESTPATEPTGPNTKPGTESTPATEPTGPNTKPGTESTPATEPTGPNTKPGTESTPATEPTGPNTKPGTESTPGTSPTGPVTTSVPEQSVITITGPCFTTVFTLTPRTNVITTTNRSSY

SEQ ID NO: 26763 - protein, 92 aa, Candida albicans
LFLPPLLRQICLTDFSYFFGFSLYICITTITYYWIVNIIIFGLKSIYYMCINLFTIQTFLFYIKYVFRLLLQVDYATKCGGIKTIRIIFKSF

SEQ ID NO: 26764 - protein, 74 aa, Candida albicans
IISNFFKSHSLSINVLSGISDGTKLCMDFDIVRVSDIIFFSTHADKQTNSVINTKRIKLKLINTFFITYLIDIY

SEQ ID NO: 26765 - protein, 156 aa, Candida albicans
TMRSIFYLNLLKNMKIKKTHYTQIFMCLKFSNSTEFSVDNEIHQKFSRRRKITVPICSVVLFDQVSTGTPPTTECDITTIYTEVVNLKAVPQSLLISCSYICVCVKLSPTSSNHTHYQSMCYQESPTEQNYVWILILYVCLILFFFQHTQTNKQIP

SEQ ID NO: 26766 - protein, 67 aa, Candida albicans
IRFEKKRLVNAGYLITLMSLNSHSQMTKLVNTKANDQSFTLSSFAECIGMDKQDCYEILNHNVNMFN

SEQ ID NO: 26767 - protein, 98 aa, Candida albicans
TKDAIKLLTLEIDWYSSIKQLNKGLLNETFKRVEWTKCSSSRERLVRTSLSKHIFVLSGISQLGFYSAQFVSKFGVLLRIGIDQQMSKAKSHRFQNIG

SEQ ID NO: 26768 - protein, 85 aa, Candida albicans
PESTFSSYFKELSQVYLRKFNQGILNTFYVCGHSPYILKFFENTKSQIKRHTYYHTPSINKQGFLLLSFRFQFLNYPHGNCKTRR

SEQ ID NO: 26769 - protein, 92 aa, Candida albicans
FKMTIFTTLGMFIVDENRYVDSNNNLLPPPHCSSSLQQTNIIGGAGTYAIMGARIICDDRQDLIDQYLGSLIWVRISLLKSNKNWILGKLEG

SEQ ID NO: 26770 - protein, 61 aa, Candida albicans
ESTAKVIAVVDAIELPKDIAPKKITGATHGLCTCDDHPYPISPIAIKRVDGIIITNLNSGS

SEQ ID NO: 26771 - protein, 68 aa, Candida albicans
KKKLSFNHENTRFSRTQTYTVIEENSKKRATEYVIDDLCVCVCVCVSLIHIRWHRSFPKRGYSTERRF

SEQ ID NO: 26772 - protein, 69 aa, Candida albicans
  UNSURE (67): Identity of amino acid sequences at the above locations are unknown.
LYIKALLPKLSNNQLRFNYNIKRSREVGILQIIPLHIVLVSLDDRLLAELIHLKKHIRRAGRRSESXPH

SEQ ID NO: 26773 - protein, 71 aa, Candida albicans
FHTHLSVMCSVNKNLYIVAWLKKKNKIEIQNKKTFFFLSFLLYLITYTLRKGYPSTLYVFILWLFSLKQTT

SEQ ID NO: 26774 - protein, 87 aa, Candida albicans
GIYIVVAKIYVLLFRNCRLQLGPHFNKITTNTIPNILVKPNPVKHQPNPMEEISGSITAVHMVADMFRAKLPIATFVAGCPVVHSVK

SEQ ID NO: 26775 - protein, 64 aa, Candida albicans
LLLLIVIARLCHSKIYTNQEVLDMPYYAIKETVTTSGFSCSTNRKKEVGNNDLQMLGLQGCVFC

SEQ ID NO: 26776 - protein, 111 aa, Candida albicans
YYNCKMTNTDESLSMYFDDDFNPSSYIDKLVNSITNLNPASSTTPVSAYSKQSLTKLSNDISHLITHLDYYTNMLTNDSLQKKLDALDKSNEIIDHVFTTGKGQPGLDDGK

SEQ ID NO: 26777 - protein, 379 aa, Candida albicans
TELTKTSPPLEASASSLEYPFESTSDQICQCTPVTVTEYIPQSPIPKEVESTTQSTKSFASESSSLEPTVSVSLSKSESTTDITAETSHESTTEQKSETLDQSTSVVTPATNQESTTDTSSDNNVESTSVVTPATNQESTTDTSSDNNVESTTAGTPATNQESTTDTSSNNNVESTSVVTPATNQESTTDTSSEKDVESSSQFATPSNPVHTSLSTEYYTTGVTSYYTSYVTVTAETTEVLTLTSCVDNHCHKTTATTGVTVVTLTTSDIQTVITTYAPLTQTVTLGIAGSKIVDLGCPIGNFGYKGYVGKGIKADDKGIDANAHAGFKIGFDAIKRDQKVANTTNVTVQSSKNAGAINSVYSSIELLCAVAAIMVLII

SEQ ID NO: 26778 - protein, 76 aa, Candida albicans
SSVITLAITLAISLAISIIPFAKDTFLCCKSDNKNFLIPLCYRTECLIIKIDSIEHRRSIFRSQGFILEEKFSHKN

SEQ ID NO: 26779 - protein, 105 aa, Candida albicans
KSLLNLVFCLRGFPISSETTKLITQDSKSTNVVNHGHVQSIVKYKLTNNVTIINKTSPLPRLQAGKPCAKKNFIYFLALKLNLSTNKGEEEGDGEHNYNPRLLEG

SEQ ID NO: 26780 - protein, 67 aa, Candida albicans
CCCCCCCKSVFRSTSFSFDFSILCLVVFNDEIYISNLRFELNKKLSKFRLSTIGFHHNNIFCVNFIL

SEQ ID NO: 26781 - protein, 105 aa, Candida albicans
TMTRQCLSFCSCNINPSIISKQKNGKVLTKIQNQPKKKIWLDQFFQNNMLTFKRIGGLRRAHKHGRSLFFFTIIRLSIDSAFYNILISYRKINTFSKEKEYTKIS

SEQ ID NO: 26782 - protein, 66 aa, Candida albicans
TMQAVMLYCFRYSYFCLTTTTDSMSNSRKQEAEWYTNNYAMIVSTINQQLLYLPDPIIKNYPCLLS

SEQ ID NO: 26783 - protein, 60 aa, Candida albicans
  UNSURE (53): Identity of amino acid sequences at the above locations are unknown.
TIELSSVIAKPVGRAPVFQSMKLVNDNVDINGGWSLYITKPGMKTRLFMSHIXIGDCVPL

SEQ ID NO: 26784 - protein, 68 aa, Candida albicans
GLTLLQLMIVQLVGMLSFVDYSKGLVNCERRKMAEKSKNRSAKEKKNLEMELLQDSVTTSFIKHFTYA

SEQ ID NO: 26785 - protein, 179 aa, Candida albicans
EICFYRLHDHSTLTHIHTTHKRKQSVPFMTPFSMYPASSKKNRFEEGTNSSKSVPLSVKVALGLGTLVGATIAVINNKEAIYETAEAFFTRGAEYCREKIEEAKIANETNFADHYQDEEFKDVSTGKSTGSNLRDESDYEDVSTPETSDFSEIDTDFQDDDDLSDEKEQADDFDTASLD

SEQ ID NO: 26786 - protein, 60 aa, Candida albicans
NRIQTHTKSGSMYFCNGVSSTKLNNSIKTRMWLKLIFRSSTCKYILIYSEPIKGDYVKTK

SEQ ID NO: 26787 - protein, 90 aa, Candida albicans
TGDTIKVKVLCSAIVSNMELQYTTSKYNRYQIFRLFDCKVGKKRNRVSSRTTITPKLCVASTYIVRLLLVISNCSENKYRWSFFFFISGT

SEQ ID NO: 26788 - protein, 75 aa, Candida albicans
EMYSRSICNYSKDMQMEKYFFFLPHHKYLLAIKKTKQPENSNHSSHPINAQPECLTMLYDNREIVTMKKRFPPAL

SEQ ID NO: 26789 - protein, 199 aa, Candida albicans
IRGESLKKKLCVHLANFVVVLRQLFPTQKREDQRRAFQKKKSRSRKSSLNKNKTHTTKLQMLTLDDDLKLVILEYHNYHLSISLEHSIDKTWNYFQSLIPQLTKHALQLIVDSQGVIRKNSISRLNEYTILEYLIKLWTPELDLNDVIDLVANLSSISPLNQDNVINGVERYEDLSRSLTIEEQVSAIFEKSYSNNDIY

SEQ ID NO: 26790 - protein, 383 aa, Candida albicans
LDEINFPVNGEMTTITFLGNLSGTDFLDPLVVTSSVTETFNYYPTGVLNPYHLYIYLLRLNFQLQLQGRKILLVLHNNCWMNRFFTNIEILYISKQLDGYYYKDGMKFPGDYGLKNWLRQSLSHADIIPNLLFNYNQLIQKLKSDPVMYKFNQLCIGKALDTVGNESLDNYPIKFENGIFVVEGETRGDEFILDYHYSIKDVISIMLRLNNFEKFTPSLPNMDWDKVSDVFVNEIFPSIRNSDLYFKFAILYNELHIKNDQSAIDRLIQPPEVFSIPPDHVTLVDLICKIDDSFKRTVDKSHLLSTLHPEKSGPSLVSSKDEDTSASESEDESRKRPNDSEEEVRTIKKSKILQLLEKNDLHFVDAFEEDEVFTTRWKDRTCV

SEQ ID NO: 26791 - protein, 118 aa, Candida albicans
LWCSPLVESWEYFLKYSLSSAKSLNLRSILVLDMVGEVREREGCLDKRRVWRINKGGEFKKKTLRAPCKFCCGSSATFSYTKERRPEKSFSKKKKSIEKVFVKQEQDSHHEVTDVDFR

SEQ ID NO: 26792 - protein, 75 aa, Candida albicans
QVQPPQQTPTSDQFPFQCQEMLLLKTNGKTLSVVATYLILMLNLIVQLYDSTINFIYIYLWGDGNQLDIFYHCYS

SEQ ID NO: 26793 - protein, 169 aa, Candida albicans
NSNMIYQRDFKDLYETLSSLKSQFRQSTEISSFRYDNSSTLEGPKVNTERQVLLPLTNQNLRGHKPVGVSEPSTKTTQRIKSRKKIPKSKELDISQEPYKTHRKHTNIGSNLGANQCKDTITVENLLDQKELDLKSRNPQKTLNKQIAEDVFSLSHITSSPPFKKSKKK

SEQ ID NO: 26794 - protein, 62 aa, Candida albicans
QVYYSYKYDTGCKTDDMHVSREQYQDDNNLFSGDSLHPNCQGDEVQVKRFKMTPNQPISGIK

SEQ ID NO: 26795 - protein, 62 aa, Candida albicans
TPSTGYYLPHKLATYKVPPHSFIWDNYAQQQLCATPLFIRMLTCCNVVCSITYKKKRLKNLC

SEQ ID NO: 26796 - protein, 86 aa, Candida albicans
SFLIDLSTKSFQYDVVVVVIILQETSTTIQVKLFYFFRLLHNQVWGREWCFILQQDTTTPPQQKKKIGHTLPIKKFGTTTTTTTLI

SEQ ID NO: 26797 - protein, 249 aa, Candida albicans
IRTIINTKVFVESGNCVTYLKMLYKNIQQTPTTIQPHTNQFRNHQRDEDEERGRAKSKDPICQSTKLHLQQDQTNPILGHAYQGSIRSRSTNDTSILANLRKPLNKRTGTEQLLFTAINQNHQSKSKLTRSISSQGVNALQQQQQHIHWSPHLPPQNKKNIPMVNNELPTTNQSRPQFRRWNLYNVPEITLKDPVLRNDNKPEGITEKNSISPLTVLKDQYDTKRPMVNNVITNTSTDNSFSSLSKANA

SEQ ID NO: 26798 - protein, 197 aa, Candida albicans
IWTTTPNDTCLLSIQFFKQLKTLKEKLGNPKKAKELDQKIEWLEEIGYELINEIISAEDMEHNHDEEDCQDESCDQKDAEVIFPESWLLSIFVKNIDGSCSPQTYAILKLIELKHPYFVQKLEAIDNEKILIKNIQKYLLNYTEKELKSFNKTVLNWCKNRLQKYPDSIRSSKHSEQISTIINQEKRILHKFIDLHS

SEQ ID NO: 26799 - protein, 76 aa, Candida albicans
RIHTFIFTYIYIYLKYRNQNYLQNRGDLQSLLDFMSIFLCTKFCNYESVKITKIYKALVLYQLKRRLVSFVLSQID

SEQ ID NO: 26800 - protein, 71 aa, Candida albicans
YCRTTVYMNKWNLNRSIVSDSVWGNCVEEEHNKNTFISSYLLVLIFMSSYLKINFQDNYALWRGLILSIDC

SEQ ID NO: 26801 - protein, 94 aa, Candida albicans
YIDDLNILVITDNSIWSLVSPYQLLFPDIAKIGTQNEKSAHVSSFFIIISYFFLSRFEHITQKMSLKSLDERRYTLSLINKNLEWMIKKKSGTL

SEQ ID NO: 26802 - protein, 86 aa, Candida albicans
CVPVRARVGTRNKANIVSKASLAALLCWEGVLVLVYLTRDRGQHRSQDWPTTTMVSAKFSYRVGAKAISSTGRRDNCCPSSKSCTG

SEQ ID NO: 26803 - protein, 62 aa, Candida albicans
MAPSTTTPCLVSGHKNFENWREYIHTHTIKTKTRIKKRKKKWVTYKLTNLASSFSLFIPLSS

SEQ ID NO: 26804 - protein, 86 aa, Candida albicans
SCCHNLEIYQIVKVLLRCYLIYYKEVILSNCQIKTNKKDAKTQNKIKNMQKCKTNLKKTKQYKTNYKQIQYKILKIEKRSKTIKKK

SEQ ID NO: 26805 - protein, 109 aa, Candida albicans
VQSGGMRATAGTVYPILGYGCAGCQRLYHSLVPTYILGTGLLPPLARKSGLAGTRAGAEIKLGPEPEPEPEPEPEPEPEPEPEPEPGSGPGSMADVPKLKGNGQSQSRV

SEQ ID NO: 26806 - protein, 120 aa, Candida albicans
  UNSURE (26),(31): Identity of amino acid sequences at the above locations are unknown.
ILRHKPKMMLAMHPYVPFYFFVGVKXIVLVXAFFLPELKVRSLESIEEVFTLPWYNLRHCNRLIADHSQIHKIKYTHDEQGNTDFNHIQYELDSGKPTDQFVENLMESESVNRESVGHKV

SEQ ID NO: 26807 - protein, 111 aa, Candida albicans
QFFSPPYLICFSLSNFSIESYIKQISITQQSRNGKKKQKKKDNIGSMEYKFSVTVKIISRVDSTPAKKNKKMGVALLHRLLAALILLVIRSSCLASTEYIYIYVSLKTTFL

SEQ ID NO: 26808 - protein, 112 aa, Candida albicans
ISGESFFSIKQEKNLYCFSTRIMRENVIWCAIDFQSDMKPTFLVYFQHLEKSYCKTSWTQDITFIANSISHDVASIGFDQLSSGFKCPQFGITMTQNDFSPISIHHFCAISM

SEQ ID NO: 26809 - protein, 236 aa, Candida albicans
KAIHNPQFSIMKFFAYFAVIALSSASLINLFKRATANGCEVESCYKAHQTLINSCNGAFDFNCLCNLPQSYFQNLYDCSKSCDTLQESDIHSPSDIRLIYCEAASNSIYTFSIDSISLDMIGYSDFETDTEATTGSDTRTKAATGATTSAGTGVTKTLETGGVSSTANSEAKLGSVTTSKSGSTSISESKTTSGSSSSGKSSSSTSSASSQQTSSHAGGASGAFVSLLGLFAALLV

SEQ ID NO: 26810 - protein, 91 aa, Candida albicans
SATMNNLIKIQYLAKYPLSPQLNIRDCLNCRWTHILRRGVDKKLDIFYSIPQYWLKYIFAPQYRMKIGTEKYIISSKKNRNLKTCHIYFFG

SEQ ID NO: 26811 - protein, 100 aa, Candida albicans
  UNSURE (21): Identity of amino acid sequences at the above locations are unknown.
SLIALHYLFLHMLRYYHFEQXQNKTKDTGLVELCDFVVASSIFTNLKTNNIFRVTSNEFENYKSQPVSLILFLFVASSNKTRSSFCFNSIRKLFTTLNSP

SEQ ID NO: 26812 - protein, 66 aa, Candida albicans
EGGGGRWNWEGGRGETVLLLSWVKRIKRKTNKEKKKEFNLFKSQELILNAFLYLKLYILINFTNSS

SEQ ID NO: 26813 - protein, 423 aa, Candida albicans
FAQSNQTAVISNRTEVYFFFCIMTSTKSSPLSILYQKFPFDQCLDDHLFDTTNLIKHGLNLTIQMGTLTLNDIPSSEENIQTVDKLPQVLSDNQTQMSETNDEEIDYHIPPSPILIPIEPPKSSIKRRNSSNSSIGSFTTTTSSSPITENSTTRSSSSSDMSLLICRKKLQNMIEEFFITICNQNEKLYQEISNYVINSIVQNESNLESFLSKIVNHKYKRELVEIIQTLFMEKYEEIKLEELIDFLNNLINLRLDAIKDLYNPSVYKMYYKIWKLNINNYRYYDEEYFFDYFNNSFSNLENVLLQNGFLLNYKKFTHYFSKDLTNYDDDEEEDEEQDNDEEELDANDKIKDDSLCHNDTAPSSPNYAYKCEDTDNQQLLLDPLDQDHIPKLLRFNEDIDIININRYLPVDHVLYNQFLNQLE

SEQ ID NO: 26814 - protein, 64 aa, Candida albicans
SSLLVGVLSVLDEGESSGGIFHYEKNNNINNKQISQKTNLDSFSIVFNELIPMTTWELSQIYNL

SEQ ID NO: 26815 - protein, 208 aa, Candida albicans
  UNSURE (208): Identity of amino acid sequences at the above locations are unknown.
IQKKKRIEFHMSHKTQSQLSSQMKNLNTPPIDFNSTSSNNTMPSEPNLQPQQQQSQPEAKTEPQTIRPATFTTSGNSSSSSISTLSADIIQPLHQLLINNNNSTVTQPAPQSSSFQRRNNPQRFNRNQLNVYTDFNSTTSSASSISSSPKDFFTREPPRIHSKLICEEIASANNRAAKEVLSRVSTDELRSVKSHTELAETANGVRMX

SEQ ID NO: 26816 - protein, 67 aa, Candida albicans
RRGFATHIMLIAQCTNKLWRTEQGKIIKVEIIITKEGGSRDWGRRSRPNAFPGKVRALPRVCWFLLQ

SEQ ID NO: 26817 - protein, 67 aa, Candida albicans
IQSKFPYVLIALLLVELIFFSFTIKVHSKGYFYTEAAAITRTTTTVSFNSEQFTILLLNQHFSSTLS

SEQ ID NO: 26818 - protein, 60 aa, Candida albicans
HYMCCKTPPLVANYSSTSSTFIHTFQAITPNKSHSKRFFLFFNSFTLLTAISTTHDQITY

SEQ ID NO: 26819 - protein, 62 aa, Candida albicans
FLVHRCCREKRGSDFPCVFTLCIVSVALFTFAAKKIVYLETTSTTLKRNKDMNSVSYIISLS

SEQ ID NO: 26820 - protein, 236 aa, Candida albicans
TNSVHNYLSTMKPKLATAIKLISVLLLYPLECFPAIVPFRDSIELVFTPEDIKKSTDYALWKIPAVKKNFKTTVKQKLLNRLLNKDLQEINPNPYDEDIFEEQQQKVKANEISNTFQTVELDIKKPNGVMRSVLKGPSSTEKKQAKLVVQSTRNTLLKNNFNDNRTENEVKLELQELSGEHLGYLHPRRVKNIKHDFNKMPSEIHENVPDSDSDSEEDENQSGLQNEKPVDPFYDD

SEQ ID NO: 26821 - protein, 61 aa, Candida albicans
SSLQHQKFVKEKRAYYIFIFQNYSFMFTFSFSFITQYKSIPISIQPCQSFHWKMIKTMTGF

SEQ ID NO: 26822 - protein, 84 aa, Candida albicans
LHQAIQHQRYFQYFNMSQSTENSNIHDNTSNPYLVLTQKMSNLKEPINELLRNHEELLVQHLGIANKLSSIPKLTDKIESSIRE

SEQ ID NO: 26823 - protein, 61 aa, Candida albicans
KCGIVDLKMTNRFKYIHMINPANRHKMDQLASHFVNHFGFHLLHCRNLNQAHFRVFLRAFC

SEQ ID NO: 26824 - protein, 63 aa, Candida albicans
ILEPDEPESMTIPYFSFELSDLLKFDIMKMGGEIKITGSEVEEVSKFMNVLIELSVCVYGKTN

SEQ ID NO: 26825 - protein, 228 aa, Candida albicans
TTIALSTTDVHLCNYISSMIVLPDTPPVAIKFKNSKVSPQLLSVRAAIELQQQVTDSTSYLIHLEEYLKCLLAYIDQNGTGNSSVLCEGIPWTNVISPKQRKIPKLGPSTDNKITWIAQNELYMTLIGITLTYLKKAAEMTNAIIDEETDNVGQFNENWKHIMSYYKTGISYILYAMNLPPVQQQEPPQLQMNNVLLSIIHKISQVSIQIVILIKFSWINRNSFQFKG

SEQ ID NO: 26826 - protein, 83 aa, Candida albicans
  UNSURE (66),(67),(77),(80): Identity of amino acid sequences at the above locations are unknown.
FFIIMHSLISNYLPMSSSSSSSSSTIHPFHPVKDYEIRLAAKLVKDAYPASANVHFVQIDRVDPPXXDMKQFIVAEXRKXTIN

SEQ ID NO: 26827 - protein, 60 aa, Candida albicans
GGINNIYLRPPSSQIRVIHSINCNNTKGGREKFIGNNQGSTRLNILITPSMKNKLGYLNR

SEQ ID NO: 26828 - protein, 66 aa, Candida albicans
NNWLVWKAKRKKERTKERKSLFMGKKFFFSCEGDPLNGEGERDKLYLVILFLIICCCRYDSKYIFI

SEQ ID NO: 26829 - protein, 80 aa, Candida albicans
QPRCQCSQNELYQNRRFITYNNSVFHLLSIPINIYVKFTHVLKHKKLLYKLKIIRHYILSLIKAGNNNHIYKKKNKILTS

SEQ ID NO: 26830 - protein, 66 aa, Candida albicans
ATSSSLERLAGWLVGYLVIEYSWVCGFIRQLHLLLSFKIRDDQIATRTWINSYDDRKKKLYTILVK

SEQ ID NO: 26831 - protein, 66 aa, Candida albicans
REIQLLLLSYSFLDGIIDPKYNLAYLNHHVLHKLILYVKKIPAYIPFPSSNLQYCNKLYINIYLLS

SEQ ID NO: 26832 - protein, 79 aa, Candida albicans
GQYFHFFLSLSSASPPYPFSRLPPHPSLLPHTDTYSHKITFDFIALKPEPPKYMHRLSGWTEPNSYSLILTSHHVFNIP

SEQ ID NO: 26833 - protein, 65 aa, Candida albicans
DLPPPYPGALTARPSSHVRRANYGELFTTRPNNSFHVETINPLIYIGLIIQNPHYHLRLVLLIYI

SEQ ID NO: 26834 - protein, 60 aa, Candida albicans
FFFLCSKEGVFFYLILVPPPTRITAKSLKKYAIFNKDQKKIESKLLKKHCVSRVHNKCYN

SEQ ID NO: 26835 - protein, 131 aa, Candida albicans
CRCLTSWCTYTANDKYCNQSQNRLNLNILLRDHEYPAYFLIDYTFSRMCSYLQTMLVQNWLRSYQLNFLLYKHHVSLRIFILIFHFEATNTFFHHQYIFHLLMDCLSNISKHDRFTCQKGYKKEPHSPFHF

SEQ ID NO: 26836 - protein, 190 aa, Candida albicans
SNSNYKLYSQEICGCRNFYFCLFLGSIDDHFTIYSRTYLIFLTLHDIMQFYTIYRNNTKAKKIKIKEVYTTNDKYCNQSQNRLNLNILLRDHEYPAYFLIDYTFSRMCSYLQTMLVQNWLRSYQLNFLLYKHHVSLRIFILIFHFEATNTFFHHQYIFHLLMDCLSNISKHDRFTCQKGYKKEPHSPFHF

SEQ ID NO: 26837 - protein, 148 aa, Candida albicans
FLVQLVMPLGVETDRWCSRHGCRKQLLLEQEIFGPGSLVGGLGSSNSTIPFGGSGSSNGTSSGSGSGSGAGVGSGSGSGSGSRGSITGNSVATGASSGPAGLGISSSISQSTTRQLQTSGSSNSSSSAGMGNVVVGMNAVALAALVLI

SEQ ID NO: 26838 - protein, 60 aa, Candida albicans
KLKNTRLVQPPFHLKAQISIERQKNLIQETNYALVHSINKNEGTVDAFNELIHCLNLNFY

SEQ ID NO: 26839 - protein, 192 aa, Candida albicans
VVIFILILFFFITIHLLLTYQKNMKYSTLAWLVIASYTVFAQDGTSVTGYTTTIVIPGSPPAGAGTAHGDTENTGTVHTTEHLTGTEETHTTGATPETTTIVAPTTTHENTTTHETSVENTATVHHNTTTLHHNTTTIHPNATGTETHTETGTGTLTGTGTEGPALTTTTVAEAFSLAAGASLGYLVALLFL

SEQ ID NO: 26840 - protein, 66 aa, Candida albicans
KNFFSSSSSSLFFRIVFNQSYEYALHFLSNCKMFILKYYVYDDNLTQLTQSFDDADNISFFQHSSF

SEQ ID NO: 26841 - protein, 87 aa, Candida albicans
IMNIINAENIPEIASVEAIICGTLTISVLITWFFENPKFHTTNAMSKTGPKTKQEITAAESQGKSDVPNVIANNNMTEPAINKNVPK

SEQ ID NO: 26842 - protein, 65 aa, Candida albicans
EEKKNRIQSYHSHQRRNNNQISIETVTMKTAARLLKYVQSIKFVGGPHPAPSMLHKHFLPIVVQY

SEQ ID NO: 26843 - protein, 64 aa, Candida albicans
KLKGVRKWRVLNADNRNLAAMPLKSGLIPAQGVQKKDYIVTSSLITKEPIKEHVWHKLKKNLRS

SEQ ID NO: 26844 - protein, 124 aa, Candida albicans
IPHLFEYRFFRKIVNIDFRLRSKIITLMIGDSGARDNGDNESIIYLQTPIEDFALGSSVLEEAGGSTPRCHDHDELSAPANNFRKIANLLLQIKLQIYHLMEVDSIPKFLETLGVTSNRIITTF

SEQ ID NO: 26845 - protein, 101 aa, Candida albicans
NVHQSLSTKSSSSSLFMIRKPVVTIVAPNTYNRFNLNCLNTQSPTIAKGIVIDNPTVTVKGLVNNTALHQQKSLTKVMTAFAAIIVATLDVGGSSNFSTLK

SEQ ID NO: 26846 - protein, 105 aa, Candida albicans
INAPNNASILPHSISRAELSVLGLSSVASAFVTIKTPAKLNNIPNILFWLIFSIDTKYPMIKVKKDDVDDNIVCDATEVYDKEALITKLAENHNTINCKDNLAVS

SEQ ID NO: 26847 - protein, 87 aa, Candida albicans
VSSSTTALTKKLDSTQNITTAARLIKPSIHFCRECSVLSGIKNARIYLRIVSFMLSVVDIESMYVITQVSKGRNLLVKLWCQQVYIM

SEQ ID NO: 26848 - protein, 66 aa, Candida albicans
PPKALPLDPNKPPPAPPVFVLPPNAPPEEPNPVAGLPKVLLAPPPKVLDAPEPKVPAVLEPKGDWF

SEQ ID NO: 26849 - protein, 88 aa, Candida albicans
FVPPNAPVVEAAPNGEVPAGLLPKVDPKADPKAEPEGFAAPAVPLPKGEAPVAAPLNPNPPPVALVPAAPPKPALAVAPAGGNLLPCS

SEQ ID NO: 26850 - protein, 121 aa, Candida albicans
SFNLNSSKEKFLYSGMQQMFWKTLVMLAESFSVNGVNCFAAVPLLTFGSTLAPPPKAFVVDAPKGEDAFAVVDPKPPKVDVAGLLPNKPPPVADDPKTDPELLEDPNADVVCCGCCCCCCC

SEQ ID NO: 26851 - protein, 109 aa, Candida albicans
PNGDEPVPLAVEPKSPPPVLPPNAGVVFVLELAPNALDEPNPVEELALLPKIPPPVVFVLVDPNGDAPVLVVAAPAPAPPPNGELLVVVLEPNPPKPDDAPPPNISIFN

SEQ ID NO: 26852 - protein, 113 aa, Candida albicans
KETSKLESPNVIFFLSICFVRVYVQCMCENNDQLKFKYFPFEGNNSSYNQKKGKGRKRKKKFLTIHLSTHHQVNATKNSYRYQVYKNRSSLSDFVLFRLYGFFSLVFVYFGIT

SEQ ID NO: 26853 - protein, 127 aa, Candida albicans
IDNCSTMGHHASKHKHKSGIHSTTAKVGTPSSKPKSSTTAAPSSTLKLKLGSKLTTRSTSRKSQFTKESRPLGSKDENDHQNNVTLNAKEALAKAAEERLQKLQGQKSGQRDRLKDKAKQSKNDKGL

SEQ ID NO: 26854 - protein, 110 aa, Candida albicans
RQLLAMGQSFYEKEQKKIKSTIKLPLLELVLKFLPHLQPTIQEKDDMWEIVAIELTNLQYSKILSSSSSSAATVTTAGTMASGGLKNEKSYSILQRTKLLAGQKPSSKVV

SEQ ID NO: 26855 - protein, 126 aa, Candida albicans
ELESMPELNGIYVRDYYEELFNKFKSDFQFSIAMNRPDVLDGSRSGNPMMANIIKDRSDALLYELYRLEFKDIELISKLSQEHLENKLRKQLNKLYKIPNHDDKQQEGDDDDVFTHRGRRSALLVR

SEQ ID NO: 26856 - protein, 71 aa, Candida albicans
LSLSKVYRIKALYYMTNFTKDNRLWYIPTINIGYDRGIFIVFLSTSCRTSTMGIAVPRYRLKINKSAKEKK

SEQ ID NO: 26857 - protein, 111 aa, Candida albicans
IPFNSGIDSSSYTTLLDGFWPASSFVRCSIEYDFSFFSPPDAIVPAVVTVAADDEDEDKIFEYCKLVNSMATISHISSFSCIVGCKCGKNFNTNSNKGNLIVDLIFFCSFS

SEQ ID NO: 26858 - protein, 81 aa, Candida albicans
YFSFIFLDYHSTSSMSYTGTTGSIPQRYPISASNENSQLLTSRSKHNTYSNINHTNNEGNANSIEKNDKDKAQKKFGGKRA

SEQ ID NO: 26859 - protein, 87 aa, Candida albicans
KKYRFVIEKRPNTRFFSQVLNESEEFIDLIDKFGKVAKFTPEELLFVNEPQLIEPPQNEAHDHQINSNFLGFPVDIDSLKEPTTTQD

SEQ ID NO: 26860 - protein, 440 aa, Candida albicans
AQESILGLSINLDSLLGSGNNKTRNSNGSTDKLQDLAPETLSLQLSLHQQQQEQPMAGLSILSSLPFTSILALTTDQPPSIDQPQPVWSQNNTLNSQNHENKSLTSDQSTQHDKQMQLTTRGPLEVTRTRNPEQDPDPQPVLSTDRPKPLEENDGVITYYPIFGDQPSLVNNGSFRHPRKVFRRLVQAQSIGDLTLEYIPEFFKQYEIDINLPNFPIPNRFPNSNQFPVIPEFRVNETNLDSSSISNGDQVLQIEYHKDTTENGNTELANNGESIKESEVPKEQPVVSTNESQPTVENDTSAANEQEVHPTTSTVQSSNTSTANEEVERAPQTAPVLPPRKLSLNDYRKIKMNQANLPHSPTSQSLPPPPPPPPPPPPPPPASSHSSSNNKSSERSRLTDRQSYSSLAIPSNRPKSNLKRKGTNDEPNRRAKQVKFANNI

SEQ ID NO: 26861 - protein, 65 aa, Candida albicans
LQYKMALAPITGTLKRKIITDITIGFAAGFGLAYLYWEVEHKPIIAKRDAYYAQLRKQKEIEESA

SEQ ID NO: 26862 - protein, 67 aa, Candida albicans
RPIHLLKIERPQISLSYNNLSFKDRQWFPISITCETINRGNGDKTHKDNETRTRVDSLKEMRKKKKT

SEQ ID NO: 26863 - protein, 77 aa, Candida albicans
RTFSPPYLFFEIKYKNKIQVTITFPLLCQVFISAKINLVCTYQECLSITTSLGRQSMYKKSLESLKYQTINMLGSNL

SEQ ID NO: 26864 - protein, 131 aa, Candida albicans
SRAKQNTGGAMYQMSPYPTEQFPGQLQPQLSQQQQHQPYAQPQQTSNYAQQSQTVPPQFTQSQQTQPQYHQSHTRTGSHQEVPQYLGYNSNNIPPPATTFNQYPPSQLQQQDTSAGFGNDVYNRAAPGQPY

SEQ ID NO: 26865 - protein, 103 aa, Candida albicans
TVFYKRMNFNKTESEAPASSPEVKPKPKPKPVPKPKPEMITKKQELPETSIRIATTTKPPPPVRRLSTPHKSPSPPPVPPARNYSRAPAPPPPKQSGPPNLDI

SEQ ID NO: 26866 - protein, 150 aa, Candida albicans
  UNSURE (47): Identity of amino acid sequences at the above locations are unknown.
LSSGWYAKTSGPLQLPKVFHGINHKFSYTTSSGSYGKGTTTVTVRLXDLSIVTYKFEYSNNDISNVNVVIEKYVPSPIDTIPFKQELIANHQRFGEYIASWCEHHRGKTVGRGECWDLAKEALQKGWRKSCIRIMLYHPWLSNITNWECW

SEQ ID NO: 26867 - protein, 150 aa, Candida albicans
HLGVNITEVRLLDEVSVGIWQKKHYKRDGGNHAFVSCYTIHGYPILQIGNAGNGVYFINNSQQLDEVRRGDILQFNACTFYDASTGVTQSAGAPDHTSVVIGKLGDKLMVLEQNVGGKRYVVDGEINLKNLTKGEVYVYRAMPHEWAGEL

SEQ ID NO: 26868 - protein, 90 aa, Candida albicans
KKDNFKNGVYDNLICFPRLVFTRMRIHPIVDDHNTCLCLSLNILKCIVSIDLKRVTILANSCIATINKGSYKLYSHRQRYMKKKKGKPRS

SEQ ID NO: 26869 - protein, 85 aa, Candida albicans
GERSWLVSFLFLFLFQVVVPLSPTPSHFFVALVFLLCCYFFLFSTTIVMSDGGGGGEFTLFYFLVVMKKEITLSHTTKFRLIQFT

SEQ ID NO: 26870 - protein, 65 aa, Candida albicans
  UNSURE (25),(65): Identity of amino acid sequences at the above locations are unknown.
WSQFFLVANSIGSRKGSGIEEPSFXPLKNFVGRGRGFQLIPGTLIKRDCAYWKIFHVVTREEIFX

SEQ ID NO: 26871 - protein, 140 aa, Candida albicans
VITNPPHQPAIITTSGLSFMLHPPLNQQIFSLHPSNENVNPPHSTLLHSGSTNRQMDTMPLQGSGGRPVQIAPSLVPPGPRSAPSTAISISLHNGPQYIPYENYQELYNYTQSLQQSINYLSGNLQKLEDRKSGSDEKPL

SEQ ID NO: 26872 - protein, 103 aa, Candida albicans
YNCVRNCKSQNICEDFFQLYLFFINLTFSARRLDTDLVLNRYLLVYSLALLALVHSFTKLILGVLLYSYKTNFRLSKGTEIFNSSNDTPLSDIKLIRFYLSNS

SEQ ID NO: 26873 - protein, 65 aa, Candida albicans
LHYTTQSLSLLLTTHTFSFAHPPLFFVFLIINHLQITTLFITTTTIKIILYLLIDHLASIFVLSD

SEQ ID NO: 26874 - protein, 590 aa, Candida albicans
SPTVPPHPPPYHIQIMLKTSLSPNYKPDLSDSDTSNDKVKNDTAEVSKTTGKNNSKSTSRLTTPVDEDWSIISSSSDLDIDDERSTTSSQDYPQLIINDSTDLSILKVPEQHVPQTSLKTGTTTHQNEEGNPNLETSQTTISTPSDSDLEMESDSNSILSGGSSNNNNDNSLNVGSKIRFFENLTQLNDSIKQKSNQFYYDFAKIHLDNYIDDQQHRQEELTNEETKEGEIEENLDDTIELVSNIESIPSENGVIDSSLSTIKDSQVGDLILKHNDNNNNTIVARKSKPVLVRAVQNLQIFLDNHSDYLYYYMMAAMVVGIIPVIYSIKYVLVPKQVVEKPLTAFDKLNQMWDHLLYEEEQEVITKRSIFFIGSGGSTTTGKHKTNKLIKFINTLQYNFHDRALPQYYVMVDKVNFYSNRFWKQSQDLGAESLIKLKLWGDQSVVILNKYSVIGLRKFDYYSQVGLDNFIKYRELSLDNLQRFYSRAGFLGKRYGHNVIVGSKRILKDITHQSQQLKTFMEEVFNSDSYDDLKENTHQQWTHLISTYNFNAAAAVSTASKFKSRLDKNAVQIYKFGKNLADSIKNELAGS

SEQ ID NO: 26875 - protein, 71 aa, Candida albicans
VVIYKNWKIESLVVMKNHCEKLKMLVKPGKDNSLRIANLLELFKIRTNIIVLEIAKAKTFVRIFFNCIYSL

SEQ ID NO: 26876 - protein, 75 aa, Candida albicans
ANLNCSFIDSFCFFFVISILDRKLKTTDVKSTSKALHMSILQKQKNSIMRFVLSLTVCHLYGPYSRVLFFFWYYY

SEQ ID NO: 26877 - protein, 78 aa, Candida albicans
NFISLLFIMAKEKKNTAYDRKGAFRKWILCTKRKDRQKKDISFDKQTRRRHHHHRRTTPGQPHRLISNLFWPKKKNSI

SEQ ID NO: 26878 - protein, 76 aa, Candida albicans
RLFHYHRLNIYTFNNQASIVFTHHCHTTNIVTAKYLLSVNKPLQTFKILRNNNIQIQAQLKTQAKRPLILYPTTCV

SEQ ID NO: 26879 - protein, 110 aa, Candida albicans
KPICTAMDTQTGKGVRRRRQELIDADDNEEEEREQITQQGPLKATSTIETAKPTPESNTPPLPLPSPPAPAQHYKRPKLKYYQFKQELEELEIQEDLSPRQQSRLEYFNK

SEQ ID NO: 26880 - protein, 117 aa, Candida albicans
HTDPSSAQDTSKKTAHTLSHHMCMNRPKYQESQSEPNKLELPLQMPSTKFDLEKQQSQSHDKQHCANKRNYLYKLIFLFNFISLLILGLVYYSTEVNPQISANLNELLYKMEKCNDL

SEQ ID NO: 26881 - protein, 60 aa, Candida albicans
FHLIHHSTANTIANDSRLEICTSLTTVVENKDKRFIKRNFQSQKGNAQHKFITSFEISDN

SEQ ID NO: 26882 - protein, 66 aa, Candida albicans
NNPNFILSNKQTISPPLPPNNNNNNYNPSQHNESSNVISFLHLDWSNDYVISFSFTITLCRPTKNR

SEQ ID NO: 26883 - protein, 74 aa, Candida albicans
IVGYGISCTVVDKMKLSLLTKKRNAIMEITFIIVFINNSEAPFKLLLVLLLSLPIDHKRIKSKRCYETSFFVQL

SEQ ID NO: 26884 - protein, 68 aa, Candida albicans
WLIRPMLISVFWFTINRGNTIIRKRARRQKKWRASKTKTKKKPPNEGKRKFCSPIEPVTITATKAKIN

SEQ ID NO: 26885 - protein, 60 aa, Candida albicans
HCTAESNSCKLDTPKTMPDLYLNNHSLIANRVAKSGNSTFSYFNFSAISASRCFNAGDAG

SEQ ID NO: 26886 - protein, 64 aa, Candida albicans
FLFCLFASFNYSPQLELMNERTNKQTYHFGKKTKKKKLNNQHFKKFFKSFQAPHTPLITQHTIN

SEQ ID NO: 26887 - protein, 72 aa, Candida albicans
LNINKMVVVNSVMPLLHSNKCITYRQTFIKKKNNNNNKNNKENFKINCSLGLHYRTSLERLPHSNPSSCFIL

SEQ ID NO: 26888 - protein, 79 aa, Candida albicans
TLVHMYTEFRNLTSRCHQAKLHIATEVGSTFFKVHCRCLVYYIFISFEPNPESVIEEHRCHSYYWYYSASTAHQPSMIL

SEQ ID NO: 26889 - protein, 341 aa, Candida albicans
KDMSINPNLKLFKLINNRKNNNNSTDTMNSQQQQKSQQQLQQQHQHQQKNKYNSFDATSSILSDYDDLEVIDDDQSLYVLFNPKSLALSSRGKQKSQHHDSDILSFTNTSNTNDEYQSDTEKEEENSEIEEEEEEEDEAQEDDRVSIDDEHNDTEVLNRDRLSHKINSWYTANVVSSSHHQLLIDERIASWELDEEANILESSQESLKLLEESKSILREFYGDDLFKYLNQDEIAKVKKFHKMVDIKNYLLDKTNKNNNSLLDQLLYKVLLFKEKKHNDTTFHRQYNIGTTDYINYLTKDVPSYSPAFVAPSTISDTTTGGSSLIMCGGVGFGGSASWNDI

SEQ ID NO: 26890 - protein, 693 aa, Candida albicans
LDMNSSATTTSTIANPPSLNSGVYSHISSEKMLQTSNKSPSPPQLFPQMQKLSQSNQSQDVLFKIFTYTIIILPTLTSILFPIKTTMPPSEHAGNLIIDLLTVLLLSLVVKHTIEWPYNWLRQLQKTKVMLLQDMNRENTDKTILLVRKIYTFEIIALISCLVSCIFSSILLIWTRQYTIIDQKRKKVVFNNVNIALLQFWSLFRVIITFTDSLQQSSMHTNHLSWETPQLKNWYQDLSHYFLPNASNQILLDHLQQHNRQFDQLKMDLISLQNELEEKKSLSNDSRESSFTPFPLNMSPTLLSPNPSVNLSPTNSRNYVSFPFKAPPSSELPVSSPPVPKRKSSTMKSSSKKSQLNTIIEEDDSTLYDSKENTFTNFDEIIPGIGITTRPPTLLDEIRSMVTSVRREVSFLDIIKHPNAVCNLLLKEFAPLLNHNFELGEYDIVRIVATEIFNNYLHKLVHDIREELGKYWNYPLYFVKKAVIFFALRLPIYAILLYFRVLFYVPWVLFRMLVLEPIVQISNLMLMVFKFALLTITTMTPKLTMSAPVLTSSPFPSPLLTPSSYSSSLSSSLPPSPKTSEKSSKIITKKSQKKLSHSNQKKLVVVPRVAKETVTSKFAMKPFHLSPILADLMTFENGVNNNYNNNNNNHTRSRKKINLQSIDTIPEEPNTISGGKKHGRFYKYSNSLALYDD

SEQ ID NO: 26891 - protein, 211 aa, Candida albicans
FYTRPSITFACFFYTLTTERHSQRYRLLTKRFFRYRKRECEKKMKVSQILPLAGAISVASGFWIPDFLNKQNSNSYPGQYKGKGGYQDDCGDDYKKGYKSKTYSKVKPITSTDCTTPIQPTGTTTGYTKDVVESTSYTTDTAYTTTVITVTKCDGGSCSHTAVTTGVTIITVTTNDVITEYTTYCPLTSTPATESTPATESTPATEFHSSY

SEQ ID NO: 26892 - protein, 557 aa, Candida albicans
HQLQLLSPLQLLNLLQLLSFTPATESTPATESTPATESTPCTTSTETTPATESTPATESTPATESTPATESTPATESTPATESTPATESTPATESTPCTTSTETTPATESTASTETASSTPVESTVIVPSTTVITVSSCYEDKCSVSSVTTGVVTISSEETIYTTYCPITSSITIPVPNTSTPAAPGTPVESQPVIPGTETTPAAPGTPVESQPVIPGTETTPAAPGTPVESQPVIPGTETTPAAPGTPVESQPATTPVAPGTETTPAAPGTPVESQPATTPVAPGTETTPAAPGTPVESQPVIPGTETTPAAPGTPVESQPATTPVAPGTETTPAAPGTPVESQPATTPVAPGTETTPAAPGTPVESQPATTPVAPGTETTPAAPGTPVESQPATTPVTPGTETTPAAPGTPVDSQPVTPGTETTPAAPGTPGTEATPVTTQPVSVLSTLQVVTASGEFSTVTAHSTSIVASCPEGGCVPEGQQTETSPSVPTNGPEVEASSSVLSIPVSSVTTSTIASSSETSVPPAQVSTFEGSGSALKKPYYGLAVAALVYFM

SEQ ID NO: 26893 - protein, 69 aa, Candida albicans
VNTYIPLLKLEKKVKKKRKLTNFYKQNFILFNSPKPNQTKHLSHVAHIHDQTLIIDSVALALKKKHHTW

SEQ ID NO: 26894 - protein, 111 aa, Candida albicans
RGIVVVVFFFFLTRHTFFLFSSTMESRKLRSKSLKVESKALFDFDNVNEYLYNDKEIAIGGNGAVYQYYGCGIPELPKLKSNTKIIELQLPIRPQRRIHYLILPTIFFTAE

SEQ ID NO: 26895 - protein, 125 aa, Candida albicans
  UNSURE (114),(122): Identity of amino acid sequences at the above locations are unknown.
DDASKAITVDIQIFGLANPKSKATCTNWNGKYANLPLSERLSTKIFSIYRWTRPGHASSTISSKLEDADDCLSLSCIKSIIVWSRPLMTSGVESNASSNTESTGGDMRIRGELXQTIRKLLXGGG

SEQ ID NO: 26896 - protein, 61 aa, Candida albicans
STHTIHIHLQTICAQYIYIHSNSYSNTINNSTVKIIKNKIRPNQKSTKGKGQRRKKKKESN

SEQ ID NO: 26897 - protein, 66 aa, Candida albicans
LTARFQLQFVEKHLRKWQLTQNQVIFSEGDTTQLSENGKNPSKKKRKEIECHLTRYHTHPRLCQIF

SEQ ID NO: 26898 - protein, 212 aa, Candida albicans
KKIFHFDFLSSIIVSSKMELSYRSYQKVLNISLKPKTTHACSKKATAAATTKKIAKPKRDETQIKRRTKTGCLTCRKRKKKCDEDKVNGKCQACTRNFLDCCWPDPNTIKTKNTKPQQQAQQSTEVKPQISPVVRPKKCDINYLLHSQPEPSTPVATVVATQPKVHIPYPSPTLSPVFTESKPNSEVSSFALPPIYSPNYKLQTKDSNVRSV

SEQ ID NO: 26899 - protein, 92 aa, Candida albicans
YIFNNICFTLISKSRGNVYIEQQRVRKNDDRQELLKIDRRDKQTKQKKFTIIFVVVQKFLRFFFFLILQFYGIFSTIKLLQFQQKQHQPWIL

SEQ ID NO: 26900 - protein, 70 aa, Candida albicans
MICKISKINPPGGPFVTDVEPADDEVTAALELELVLAPDVTLGALAVVLIVKESALLARFSPTLPLRKLA

SEQ ID NO: 26901 - protein, 71 aa, Candida albicans
KVIFNKREVKEEEEEFNFLVRTKLFCNGKLLVSKLIESKIGDTKQQQEKNDYTINNGAITVLFKIMNCVNS

SEQ ID NO: 26902 - protein, 82 aa, Candida albicans
AFPTEDAVFKTGDWLVKLGIKPPLAMPCLFNESDTSHGVNLDKIEMTSLDDNDLVIDISDGGFQLSKNGSRDIFETIVIVKG

SEQ ID NO: 26903 - protein, 166 aa, Candida albicans
LTKSINQRIIQTISPGMPLNLLLHEDNHQKRPMIVLDSAYDELRFSIIGNKDLKYKLVGNVQFIKQLTTDFEHLINQLTEATNVSLEDTSYLLENLEKLAVITNILCLFSIEVDNKKDENIAECLSTMKLVLNPIIRLLNYFIQSFVPALYRHNRKSIVFRYSKQI

SEQ ID NO: 26904 - protein, 83 aa, Candida albicans
LITFSATLALMVFANLVPETTTASKLIHERWKFLLNERIVGLNLSIAGGIESEKKEKRKKTNSCSFLRKSITKFFRRVYAVSV

SEQ ID NO: 26905 - protein, 156 aa, Candida albicans
FSFFFVLVCSLSDLLSTLDSIQTHNYNQMPNESIDNSGEVVFPQPNIDQKPPPPPPTSNTNFLTHVRSRLPSRSVSPYAYRTRSDDRQPITYSGDNNTIIRETARSELITRHQLQNVHLDQSRRGRSRSREKKKVDTKPHVISLMGFDTTTTLKKK

SEQ ID NO: 26906 - protein, 157 aa, Candida albicans
LVPIMLTRMFITSKNKYNKKIENAIKKINKLTANPETSFKFDAERFKEIELFVYGQRPITYKPAWGLKLFWKDNLPTLRYHNPDIQFTVNNITVESESELSKLPLKLKVHGTDQSNSFEINCTDKPPSKILSELIEITKARKLTEEELPKLPLRPVK

SEQ ID NO: 26907 - protein, 125 aa, Candida albicans
TNNSISLNLSASNLNEVSGFAVSLFIFLIAFSIFLLYLFFEVINILVSMMGTSYCIVKMKKSKLENFFFLANKKRLVDISKYHTTANFKVSNSSWFSIGKAYYRQLLLVKVSSNQLFYTAAIAMF

SEQ ID NO: 26908 - protein, 61 aa, Candida albicans
LSCEKLAETKQKLLLSIILLFGNCSTTFRRFCTLPPQQKKKKEEKRNEEFQVINYEIIKAI

SEQ ID NO: 26909 - protein, 60 aa, Candida albicans
ISSPVIIIETLGYDSNILWTTWLEGCALSLRTLSVHGCKLEELSLVKAIILFLKKISHVK

SEQ ID NO: 26910 - protein, 60 aa, Candida albicans
HSLVLTNIFLKSGTRAKNKCLHFFLNYHQPSTCTQHKVKKQKKEQQSLNNPISQIISVLK

SEQ ID NO: 26911 - protein, 424 aa, Candida albicans
FFTYISSSCFLESSSLVLNSHIRLNMSTQVHLNPTMLSILSISRDKYWIFISSILQLLYHSVDNSNFQKSSIGNEDDDDDDGNGLDEYSSNTSASDGDGLNTKLVDNSSKLPPSPPLEEPIEEDTETEDYFFHIALTPVECTIICSQKLMKQYFQQPIEICKQLNYHDVQLLPEKYLCLSVDCDGSSDNSLRILELTKPLSENNISLFFISSHFNDIVLIPYDLKQKVINILTKNSFEFLDVSNSYIPTFGASPIATEFDFEQGSKKLEERTFESFKQSQIHPMINNKVKLLLTGSRQGEVNNAIIKSARILSSTETIPNYFAITRTYYNEVSLVLPKSSKQRIRLGFDSKYIIGSTQDIIIPITIDFSKLPLDSTGIVAGLASKLITAGENVSELYYFSMARSGVVMIPQENIETIAKILHDV

SEQ ID NO: 26912 - protein, 95 aa, Candida albicans
NMTTINLDFHPTELVKRITKRIPRSLPYYNNSDLEADSDDPIVAELMKLRPHSSRFIISNVLYNEEIVQYSAKLQELLYLLLEEKELDDNIRINP

SEQ ID NO: 26913 - protein, 475 aa, Candida albicans
YQMYYIMKKLYNIQPNYKNCYICYWKKKSWTIIFALILENSLSELTSSLPALKPDDYRYNNVSEPQTKKPKLQQNLRTPHLFQLTFPNNYLSKILIDNFDSLLKFSTSYFNLSLASHITKYVVELIYLLNYWEVVHLVYLNSNIINFLQLLDFEIVNGSFGPIVSPPENYLSDIMLQGLQYPYPYPFYNYSYHSFNSTVEEQKFKKISITPYVDITLKNVEEPVQKKKRGRGRKAKNALPNKEENDPATHIVKTQHPDVSKQGIEKDDALTAEVSGTVSEVSDNEMEKQPQPKTSVKSSVLPLASAMTLNVTNTETMPVALDARKMSSVSVVSSTAMLPINTISSTYTNQPSYYATQSGQFFPKFGEFASDKHGTHLPVPRNDTSADRTGSLSASPIPAPNNPATHSYPYYPYSQSSYHYRHQTNDQTNILSLQNPKSNTISTMQSPNEIFVSGQQAEFSYGESIPGGFRKTKRS

SEQ ID NO: 26914 - protein, 87 aa, Candida albicans
ISPFSPQLEPTFSSEFLQTRAQNFPLLGNDLFPKMVKNVVASKKMAKNPHTKLKMTKNVAPPKKDGKKKSHPQERWQKYVAPPKKVA

SEQ ID NO: 26915 - protein, 69 aa, Candida albicans
TTPLVWNSLLILKYSQYEQLLEPQIQISQINNSLVEQHPTQFKHLYGQSTISSIHTNGNAEKRWQKFFC

SEQ ID NO: 26916 - protein, 72 aa, Candida albicans
WVSYSTVLEAVDCVVVKIGVPVGDPWVIGEPGTRQQKKMAEKKMAEKNKLFYTSFFLQQPGNQQSINNQSDI

SEQ ID NO: 26917 - protein, 65 aa, Candida albicans
PQPRLTKGGERGTGLIYGSLTTNKSDFYVLATPNSKIPQDQANSINCLTKPNHSKTTPCCNHHNN

SEQ ID NO: 26918 - protein, 82 aa, Candida albicans; identical to SEQ ID NO: 23926

SEQ ID NO: 26919 - protein, 72 aa, Candida albicans
SCESKVYLASELTGKIVKRGVEKDNASTAHRKKKLRGHFFCSTKYSINQLDGAKSNATSGMERGANSSKLSN

SEQ ID NO: 26920 - protein, 140 aa, Candida albicans
SLNITKMPEFKSHIRATFEPTDTKLLTNTPTSRLLTESPKLSTALSQIFPYLLLIDNLLEILTWTNEDHYQNFLLLTCYSCIIVYWKWVSHVILPILMTLAFSSIVWFISSIIYDSQYDEKPTIEKMSFTFTNLTIRCEM

SEQ ID NO: 26921 - protein, 207 aa, Candida albicans
ITQNNNRNTDGNQVPNSILFILFYFIFLNRMVSRKSSSSSNKTSTSTDTMIETIGKPQTVNTSYTSSHDFIPSRPPPPPKIGSALEDTEENTSSSQSSKVSKQDKLQEFSKKLFKKTSSSSLNKKTFYQKLRGKEKKKQRIHGTGVDKNIQTDDITNSLTLDMLDVKKKREKKYRENVTLSLKTFLDSNTLNGAVDSFKDYVENSLI

SEQ ID NO: 26922 - protein, 89 aa, Candida albicans
KMIKKIHSKCEDTHCNVFYSKIRSIIKRCLCMGLEQSNSYQRGEILLTFQPHGKLKWLVLIEGFYSSIKQKKKIATDNLLLQYNNAILQ

SEQ ID NO: 26923 - protein, 105 aa, Candida albicans
GMVSTPGDANVGLSCGDKYDNAGRSDTVLLLFEKEAPLMLCRLEKSGLKAKLFLSSSAIEPNPLRCSPLVDGEKNCGFRKEDSSLFCGDMSSSKLTELDIGLTNC

SEQ ID NO: 26924 - protein, 160 aa, Candida albicans
KFFLFYLVSRCPKWANRLHVQDKFGISIARGGTSQEVEHGQFVWYCCAYDTKKTETRKKIDRQPLSTHLQQQQSSSLNMSQVQQKPKSFGRLYTMYYFHFPFVMLTTTETMLLHTFVLMFALLVAYGIYAYLPSSIMFAISRAYYYVFGMDISTINGYAK

SEQ ID NO: 26925 - protein, 68 aa, Candida albicans
FRNLRYPDETCDMTLTFYCSKFFLAIVRNDNDDNEEEEDSLWLHNSDGLIMRYDRDQQEKPVLKPSFG

SEQ ID NO: 26926 - protein, 69 aa, Candida albicans
DFPLSVRQTFFYILQHKSSKGINATWLNHAVTCWRNNLSTVLIATNRDWQIPKEHTILCLFYPFFFFTR

SEQ ID NO: 26927 - protein, 73 aa, Candida albicans
LKFYVCLVSRSHSSLQLFKFKALGSKYFRLGSKKSIFHKLDLYLLLRSKKIKKKLIKYHILYHAPCFGDALTK

SEQ ID NO: 26928 - protein, 98 aa, Candida albicans
NYLGGPILDGSGLTGGISARRILLARRYSKTNLLTMRLHTKHTFRVDDPVTQLYLIYADNTDDTTEYSITFKLGAQHILKYTTQSNFINVKSPLCPAL

SEQ ID NO: 26929 - protein, 97 aa, Candida albicans
RQIMKKKDGIDNRDIPISHAEYMNKKQITSFTKQRTLIIEVLTITMNRNVLETILISFLQVHLPRIIIFFFFFLSIARIPKKIESKKKKFHATWPLL

SEQ ID NO: 26930 - protein, 141 aa, Candida albicans
YKQELKSSVQQSWAKLPIYILSFTSRVLSIIYSLAVLTKYIKFKKSFKSGDLIVEFLETNEVRTIEGCNISVLQQKQMSDVYEIFTEIHILSQLFVLCEYVKFKLSYSNEDLAALSIQRLNNLNQHLDEVLQQNFTKIKPE

SEQ ID NO: 26931 - protein, 64 aa, Candida albicans
CTYYYHVQYASCSVVILFLLSLIHDIALKYFLLTNVCNQKKKKVWEDTSRVQQKVGIETKVCGG

SEQ ID NO: 26932 - protein, 137 aa, Candida albicans
TKPRSVSKQIPVKSVYVPPKPNALIILSRTPVNNAANQHLIKLTHEADAPLCLGYKSTHIVVQIDIMTEAEKEIKMVEMIIDIIGFLYSRHQPNAERPITIMAKGTIVNVSLDATKLKGGRSFKGTSFICLSYKFFL

SEQ ID NO: 26933 - protein, 103 aa, Candida albicans
INTALFNTFLGLMDPFPTILRDVSAKTKKAKIKVTPPPIAKNINIALQVWNPEINAAPTNPPIPFPANCKPETAPTIPPRLAGVQISPATPELIANTGAMPAA

SEQ ID NO: 26934 - protein, 86 aa, Candida albicans
LPAPMTNPLDFPDECAFYEYKESIPKLTLRNWYASHNSSYIDLRWLCVQIMGSVIAIGNIQLSRCRLLLQDVQMNSLEYIQSSPNL

SEQ ID NO: 26935 - protein, 64 aa, Candida albicans
RGFFFLAQVFLVKTVVHSIESVLRTISPPPTSISIRAMTVSYTYNCTDSKTAVRSFATAMKNIL

SEQ ID NO: 26936 - protein, 68 aa, Candida albicans
FHLSNYPPTMNTLKVVVAVFVRVVQLVANIACFVISLLRSREYNYLTLTVTSFFFTTRRKIRAILWPP

SEQ ID NO: 26937 - protein, 252 aa, Candida albicans
STYNMSWKPIVTYIIRGAQSVFCIVVLGLSAGFLADVGYNYDRVTFALVVSILNLIYFSYILLLMPTILKNFSPSVIILVAEFIFFVFYLSAMGAIAAVIPSGSCGDYGSYSSACSILKALIPFTLFNWLLFATSFGLFLGYSFIPQVSSRGFKSIFLPARFEFGAIFTDFALPFGKKYAVTDPVTDAAIANAEVTGSGIENDAPKVASVGDNEATVGLASSEEDKYTEPISENIHEAPATQESTNQNKPYP

SEQ ID NO: 26938 - protein, 87 aa, Candida albicans
FTKRKYQNPLNFLYTFFSLASVYVLPMVGTTRVYLNATTAISYFFIHRQNTMNLLDGILLTHCRPVTIFSLISIECNDMQLVNSHSQ

SEQ ID NO: 26939 - protein, 82 aa, Candida albicans
LDQSLAFGLGRILNLLNHANSKQQSLIFDLMRYEHTFIQRADCFVEVVAPEFIKAAKSYFGQNSEKLAKFEQDVISAGKTNS

SEQ ID NO: 26940 - protein, 67 aa, Candida albicans
EKKQQGIYFAQCFVVLSDELQCKNFLRPSQNDMIFKNNTFSIFNLIYLSLHLLLNSFMFRNAHFKIV

SEQ ID NO: 26941 - protein, 175 aa, Candida albicans
LNMNMNAKNIRWVEPPATIIDETIMNSLVPEADLPVKPILKLPRNTPFPFASEDDNKELEDQEDLNKTKQISNLLRNHFICIMKSIFGLIKMLINNQIITGFTNFLISAIAFISITALRIIAAVGRFLIDFDFSLFFESCLFLLEEHELYFTTDLSHQHPNRKSNKRRVTTTAGT

SEQ ID NO: 26942 - protein, 71 aa, Candida albicans
IICRTSNIFLGFGVVYESTCYTKPNRCMIMKKDYLIVPIVRFLSVGTNKLYRCSDHCLIQKKVKNNNRLVK

SEQ ID NO: 26943 - protein, 78 aa, Candida albicans
LSTSQQSTIITQLKVEEKEYKKKPCLHIYFITIVFIIIMVMRINYSNFIKHNFESTSPHQPPSILFPKSIFIHIIHYY

SEQ ID NO: 26944 - protein, 109 aa, Candida albicans
STIMRKIWNRKDKDKRKSVSHDTNSPNIYSNHHFDSNEHLRTQSHQQGSDQYSDHNQNHNHNHHRNHQHQHHHLVHTESHEDTTSFDYEDMASIHAQPYSSSDKRPTTK

SEQ ID NO: 26945 - protein, 79 aa, Candida albicans
ILKFFLGFFKNFLQPVHSFHFILVQFSSVHFTSIQFTLLIHLFNCFFLSFLPSLFFINLLGSYKHHIHFFIFLIFDFYY

SEQ ID NO: 26946 - protein, 71 aa, Candida albicans
LWGVYLRTNMVVRVWMPYLHNQNWLYPRVTQCGQGGDVGVGGCGGDCDYDSDCGQNIDPILVGVIVYASVH

SEQ ID NO: 26947 - protein, 65 aa, Candida albicans
KKNVTFLVSPLNPFVFWCNCLCYLCIMTTLIMQLTNRFEMIDKSNRCQQLSIIILFPIINLSFNH

SEQ ID NO: 26948 - protein, 63 aa, Candida albicans
NNQLHLLEYKKETKIKHVYKSYNKSNKKKEDKIIKKKKIRRNKKSILIIVVGAINLLNLYLSL

SEQ ID NO: 26949 - protein, 65 aa, Candida albicans
LCGLLEIVIFGWGINMESGFQLGVVAKTKKVEDSVNSQIRETGKKKKHLGPRYYRFKIQEPPKLV

SEQ ID NO: 26950 - protein, 69 aa, Candida albicans
LPLSVKLLPTVMLFVFAHRDYLNEPNERNNSNLTGIAVSIILILSYTYHSIINLGDHLNWLEGEDCKHV

SEQ ID NO: 26951 - protein, 345 aa, Candida albicans
KPLSMLIPQPKITISKRPHNQKLLTKAKKFSLNQLQDIFHEETTEIKSFVETSTPQPKQKAPRRKWPSYKSIEKTTFKKQKQKNTFASKHRAAHTPEEPNSYQGVHALPPLLIKDILNPVSLQQPCQAHENLCQNQYLDSNFHVLEAKCSNFIPISSSYKPPHNTFTRSYTCKSFSAAENHQSKPIHSDSENEYASTHKLPVNIPSIDELRRNIYLKKCSLNYILNPKRTAIDLSSNMQLSTTAPCYSVSSCSFDHELFSFSDKLSENISTLTNSDGKEQDYTLNDISSYINGTSVRMSSLANGNTNNKNDWLNQIKHVCNLHPPANSNDPLDLLCYDKYMIILK

SEQ ID NO: 26952 - protein, 392 aa, Candida albicans
PLFPMSIHPGTKEEINGVTKELSKVGIMQGSKQESKPVLENHQQQSFTPNTSLQSAETNLPDTPNTSISSADTTLGTSTQELVKSIPPPRVENNRRLIAIPKPHYNVVKPTEYTPLAEYYAAQSPHHPKLREVRRLESAKAPIDLYRIANRNNNINVPATKLTADISAMFKYSTNTEVRKVISNLLVSTEKLLKKKLADLPTYFKKLVHAFEKNPEVYLRVNAEPIFGENYTVYEYFDDRDLSHLYYRCRYFHIDDDHRIYFQAFNPDTIGKPEYAHLRQLLVSSLEKLVFEIGGEKFLIKIDEPVEHMHVVAFKLPPTSLVDTVEYLEYFLDEKDEIVESRIPVFSPKLMIQDSTPVTAFFILKLRGKQLPPERKYIFDEEYSFNILTDYS

SEQ ID NO: 26953 - protein, 133 aa, Candida albicans
LTKSPIIGIIWTIFFNRLFGPITPVTNEFMNVSYPMANNLPDLDSLIDEKVNRILNQITEVSNQAKINVQFLSKSSNNKKTGWFGNSTYNAHDDLVVWESWLINVESLPLDQVSNGESKNVQTSIQNFANNLH

SEQ ID NO: 26954 - protein, 92 aa, Candida albicans
  UNSURE (43),(45): Identity of amino acid sequences at the above locations are unknown.
KENKYNVMEMGNEEIIQLVQKGIKKKLNQCCLTVFPRLGCNSXSXSHNCRSIFGLSFYYDGYSFLNKDNTNVRFPNLEICDQKLYYLVLDNV

SEQ ID NO: 26955 - protein, 87 aa, Candida albicans
TWSRYRSIRYRMANPKMSKLRFKTLQIIFTKIYDIADKFKEHIPPITSLDSAPFPYKIIIPEKKSHHNRDYHTGEEGWGTYIKKILD

SEQ ID NO: 26956 - protein, 65 aa, Candida albicans
LSILLTFSSINESKSGKLLAIGYDTFMNSFVTGVMGPNNRLKNIVHMIPIMGDLVSHTWLTNKPV

SEQ ID NO: 26957 - protein, 143 aa, Candida albicans
IVGVIWGYPKTHQTIIKIGGIKFTGKRRIQVTDWFQTKTVGPVAILYGEKNLERNFEFIKKLNHIGKINLTALSQYNNDCDAASVDKLFKIGSKTLEGQIGLHRFNLKPEEKERFLEFLLYIFVWDPSERRNTHDLLNTSFLE

SEQ ID NO: 26958 - protein, 122 aa, Candida albicans
SSSHSNSPQRNRNFGVKKLSQMFPLTINAIEKHQDISNYKTSGVDGLSISFLTPPAVTVATLEEIGKIDGFDKVIKGLWFQPGSYDNEVLELAEKLGEFDKVVHEDECILVRGEEGMISANL

SEQ ID NO: 26959 - protein, 70 aa, Candida albicans
VFMELCVGINAGIGLCRFEFIKCDGKGPELFRDGVNVHGAFSTGVVNGSLVAWLFESIDGSLNDGSFGTN

SEQ ID NO: 26960 - protein, 61 aa, Candida albicans
TLTINMSMTSKIKSFFGKNTQYAVAGASNNPSKFGYKILNWYILHDLPVIPIHPKETEILG

SEQ ID NO: 26961 - protein, 64 aa, Candida albicans
KKPTNVCMYVVACSSATENSGMKKKKIEIIEPLLLENNHIFARNLSKSLFCLLVSHIFFILHPG

SEQ ID NO: 26962 - protein, 74 aa, Candida albicans
LITIHKYTILTMSPTAIRLSQKITVTPQYKYYLRRIPDFAMWATGIACFFGWPHVMVDVSNKMVGAPGNRGFFY

SEQ ID NO: 26963 - protein, 63 aa, Candida albicans
GILVVFKDVVVCCGFIVYQTLDQFRNTKTRTIKKTERTWGERVCPTSTSQPFILNTNTYTKPT

SEQ ID NO: 26964 - protein, 126 aa, Candida albicans
KFSDENRGISRGIYSFFISFLERKYFIIKLNNYRRLACKSDRCTWEIRGEGDSRENEKIERPANKMDEEQQQQRSRWGCSRLCHKTELLTRCIILHYVFLFLIQRAFNSWSVGVVPFTLHAQHTFL

SEQ ID NO: 26965 - protein, 100 aa, Candida albicans
  UNSURE (78): Identity of amino acid sequences at the above locations are unknown.
LRYVEPATYKTNVVYIRKSLSMLISMKNTPLLKPCAVCIVITPNASTIAETNKRQINRALLASENYKQRTQIINMHQXTVYIYEKHLKYPNWEWSPMFLL

SEQ ID NO: 26966 - protein, 79 aa, Candida albicans
GDDFKNREIYTADRQCFQIKQDQTHYKSPSSWPATPQNQQLLAQRKTFGTQTTLHRFPKKSVPGLSQTNRDPQLENVQC

SEQ ID NO: 26967 - protein, 85 aa, Candida albicans
RIIELPISEKQPKPNQPKNKQILKVKTPTKGPKPPCGSHSPPISIPNLLAVYPQKGVFADISDATIQASRSNPQSYGSGDILGRR

SEQ ID NO: 26968 - protein, 71 aa, Candida albicans
VLYPNLITIQCVLDNKNKLQNYFFVFWQSHLTKRLFHQEERKKKLIKSEISFIYSDCRLFKSNFYVVFFSN

SEQ ID NO: 26969 - protein, 160 aa, Candida albicans
  UNSURE (137),(145): Identity of amino acid sequences at the above locations are unknown.
AKPYAMDLLDGIEDYSASQFKPTQVNAMATTQQDNENSDSDNTSQTQPNQSILGFDFNITTISKALNSTNDNQDKGDDDGMPNLSILDKVKNRLLGGGDASDEDENTNPDDEVLDKTQKIVHPSTGSAFQLLPQLEXGGGGWVRXSVNTGHTKDETNPKD

SEQ ID NO: 26970 - protein, 65 aa, Candida albicans
IEFKDENLISKSSKVNFDVLYECLTHKETVFQSFLLTTSAYSIYIYNIYIQFSYRLLIIYSSRRI

SEQ ID NO: 26971 - protein, 64 aa, Candida albicans
KLTLIKPWSNRKKKTVIDLDVQLATVDWSHCQDPISSKSSTLIDGGQKNNKRKVISSDLYNLGT

SEQ ID NO: 26972 - protein, 77 aa, Candida albicans
LISSSTFLPCGDLDRKTKPIKIIWCRSESQFILLLLIQRHNTTLPERVDTGPNFGILICFFYNQRITAFFLRGVKDY

SEQ ID NO: 26973 - protein, 86 aa, Candida albicans
AKSLSNSQYMGDFNSMVDYKKDTVVKQDLQYFMCSPFEFNSESSTNPLSLLFYYSLLYTTSLRITIHTFITYNYYILIISFESIES

SEQ ID NO: 26974 - protein, 64 aa, Candida albicans
LPNNNDPLLYLSFILLIGLDKSDIPPKQKLETASRYHKILKLMALMGLLIHFQKDLNSNKQLLD

SEQ ID NO: 26975 - protein, 90 aa, Candida albicans
QNPSPIYLLNKYFNFVMKSNKELVTTIHKAKFLELGYGLVKTTLVLWIMLLYLLFPIHDNPLLWPYGFILSNFGAALIDVLSLVPGAIFW

SEQ ID NO: 26976 - protein, 89 aa, Candida albicans
TCRYDDKVIHRINCKILLIHFHKYPKICLSLYLKDLNIKFQLQFIACASFIIVISLVNLPLLVNYLSSYCNVSNCGQILNFLSCFGSDL

SEQ ID NO: 26977 - protein, 91 aa, Candida albicans
KRDIIVDHYYLGVTERIGQWRQVIIGHLVLYFEVPINLDAGPLTYLIFIFQVIFINLQWELCFRVMCLAELVTLGIGVIVVTWFVVSVVAN

SEQ ID NO: 26978 - protein, 67 aa, Candida albicans
MEYVVVNIKEWLFLNWIRIQPSLVTWLYRNSGVCGYYYFRMVDVLGNKNLKYIPLDLSCNVKDKNDY

SEQ ID NO: 26979 - protein, 72 aa, Candida albicans
FHQVSMVCHSMRMSTSKKTSTKFSHTLKFILTYHPPYSLLDYINESTYYIHSKIDNMVLIKICFILVLCIKY

SEQ ID NO: 26980 - protein, 83 aa, Candida albicans
KSFFGVKFVLNYHQKLATNYFFFFVCGLNSTIHTNTNAVSIDLIMIKEDIISNKLFVIYNINEVETDAKDSAFMINPQRTINS

SEQ ID NO: 26981 - protein, 109 aa, Candida albicans
RESQIVMSNAIDFGVVDDSEEPAVYTTFLPRPISALARVNLVLHEHPVVKYKTITRVRGGDEPLLSGEEERYGTEDERDTEKRLVEHNYDWSLQYLPGLQFGVVSIRRS

SEQ ID NO: 26982 - protein, 89 aa, Candida albicans
LNNPLVWNNLLILKYSIPQQLLEPQLQLSQINRSLIQQHPTQFRTLFSLLNYSEYEHLPEPKLKRSQINHSLIQQHPTQFKHPYGQSTI

SEQ ID NO: 26983 - protein, 72 aa, Candida albicans
IAQYVTSANGISTIFCRPLKKVHAKFEHDKKKTTAIYQIRLMLEEDTSSDRVPPPNPNAFVCGVRSRKTSLI

SEQ ID NO: 26984 - protein, 63 aa, Candida albicans
GYTRWVFKRKGQLHLQGVSCWVCEWKWRDMVPAYQEVVHYSPNWVTWANKERGLVGVVKYVDV

SEQ ID NO: 26985 - protein, 152 aa, Candida albicans
TGGALFSNGRFFTNWNSRVEHNFLRTLIRSVVRHTTVMGYIRVIYYTGPLFVFIYSTYSFCIVTCNLINKNVVTMFRRGVLTVSYTKSSKAVTAQDLTFTLGITRVFCKSFKLIKRLKTFCLRNWSKFPPKNNHLRIVVVESTDSSKERSAI

SEQ ID NO: 26986 - protein, 100 aa, Candida albicans
RQVKRNLSIKFHPEGSSSEIVLNFPKIFWTSSDVAPAKTNQGGATGLIYGSLTANKNDLYVLSTPNSKIPQDLANTNKCLTKLNHSKTTPCCNHHNKSTI

SEQ ID NO: 26987 - protein, 74 aa, Candida albicans
QPQFNQFGTLSNEPLGNRITFLRFTPVKECIASFNEYTNRMANLNNCTINLELSSNFNHFEIEQLPEPRTQPLI

SEQ ID NO: 26988 - protein, 74 aa, Candida albicans
IGIFPSCCVDSLLAQKLMLWQTWRELFVFEDGEIIALVDEDSDPVVRRQLDDLLLRQIEQSYHGILPLVLSSRK

SEQ ID NO: 26989 - protein, 148 aa, Candida albicans
KKEEEAKKKAEEAKKKEEEAKKAEEAKKAEEAKKVEEAAKKAEEAKKAEEEARKKAETAPQKFDNFDDFIGFDINGNTNDEDMLSNMDYEDLKLDDKVPATTDNNLDMNNILENDELILDGLNMTLLDNGDHVNEEFDVDSFLNQFGN

SEQ ID NO: 26990 - protein, 97 aa, Candida albicans
KEEDRKPIVQLYRISMTDCEWSKLDHDHIERYPESLKEKENENDPIPSEVLVIWKQLKSVVDTVLVRKEKRINVEQMLQMDEFKWITDCLPDFIVNV

SEQ ID NO: 26991 - protein, 64 aa, Candida albicans
ASTTRTTTNEKENSKTTSKENETVRPDDILIKLNYDYLLSMNNLQLMINEITKSCFQYLQQQQE

SEQ ID NO: 26992 - protein, 66 aa, Candida albicans
IWFGYYFVGFECTHTSYVLFVGGISQGNRLTIKLISIVTKIGKSNRYKLSQYLLNLPTGRKIRDAY

SEQ ID NO: 26993 - protein, 60 aa, Candida albicans
WYLTRYLVIGVIIYSILGNRLPLDIPPRSSTTHSNSSTSPNRGSPTVIKRRRSKTNSTAL

SEQ ID NO: 26994 - protein, 72 aa, Candida albicans
GRHCSLVRKFVSPIVYPHGIYSHTIKVLITIHYSYILVVTLFRYIYNSTTLTLLIYLHILNSASNIEVVLYI

SEQ ID NO: 26995 - protein, 672 aa, Candida albicans
PIALRNTSNKQHIASMSTFKSNKIISKPNLQPVNSPTISEQSPATTKDQQAQMDRIPTLESILPPSNLTDIESFDQNHEVSPKSRRTESSSVYEEAVDTTYQYLQQQLPQQPTNTSIISKNSSNEAIPVSIKLSQLPNNSSSSLFINNRTRQPNSPSVNSQRGHSKSPSKNSHFSTRDEPIKENLKPSSESSSASTHSLESPITPLIRKTKPSSQSIQNQQQKSPSSSMVSPGLLITQQESTDSQHQPSPALSHLSVSTFGHKKRESMLSTYSGAVEYDAVPMTVKRSSSSKIKYVGNASQGNANNNNNYNNMVSSRAHHRKRSSLSSTSTSNKYSDLNTVSDTKLIETSQLLGGDANNSNNNSNNTSNSSRRNRSYYDGDEEEEDDSSILMGKLPTRSSKEDELKAQQPDKSVTTNIEGSIPARSPRRPASVMSPNFSSIDMINSSSISNNTTGSKDKSRRKSYVEDNKRRSIQINDGLEKLMLDATSFTSQDENEQQGDEEEPDYDNTRFIRDVTPNHLNIHRKNGADEYNEDDDITPKFDPSLVTAGSHNGVGIDELDNNIPISSRNSSYELWSRHESKRKSLTQPLNLPPRPTKDNLTKARTISNNLQQQQQQQQNLQEHYDTLDGNPDNLNAIEGEEIFPSTNNYVDDEEFEQEGMPRSQKTHPPCC

SEQ ID NO: 26996 - protein, 416 aa, Candida albicans
ASADLDPRGQDKSGSGLPNKKKRRRSTANIDSEELAKRKNETKQLHSIIEKRRRIKINREFEALKYLIPACRNCNTGSSGGSATPTSSTKKASTNSNNNGNKIDGMYKLTILKSSVEYILYLHHIIQKQHQLLSLISAKDTNGGILAEKLKAFEDFDIDFAKVPLNVNQYRNIDKDFNFKDLMQDLDGRSVNTESPETIIEENEPVSETSSTNNTTTLHYSNSSVLPSRTSSIVSSRQSLLLPTPELTPILSILNKYSTSNNQLNNRKNSNPISPQTVCIKSQNPSPFTMPMKSSLSTSIVNSPSSSSSLSGSKSYMAGNNAVNTVKFSLPDPVVNPNSTLNDNIPRKGLISGIPEEEEEEKINKGLANTETVNSGSASSDENNDNDRGVLLKLTDQDVSKTLLALRKSSIDSLLN

SEQ ID NO: 26997 - protein, 62 aa, Candida albicans
VEIGKRGELEIKTTRLRLYVIKYKPQQNLVRDARPPPHLVAKKMGLDFVCDKLWSPDVPKKI

SEQ ID NO: 26998 - protein, 77 aa, Candida albicans
QALIEFEYSIIEYFLNLDIVNKLIEQATKLYEAEPANNNNSYQLKRLFESRGELKLLQRSSLIKLARENSIEIKGLD

SEQ ID NO: 26999 - protein, 64 aa, Candida albicans
LGLDIGSAIVIKKSCACSAKGENDSKMILPSFGDIHIGLEKWSGFSFKYEKSPLPKFLETASGI

SEQ ID NO: 27000 - protein, 66 aa, Candida albicans
TYKQFVTTTTSLQIMFNQSIKTPLLNSLFLYSLVFVGSRRKAQTMKNKYISNLYLHLIFEFIGPTS

SEQ ID NO: 27001 - protein, 184 aa, Candida albicans
ENSNYLQQYIFSSISLAKMFSRQLARQIERNKHVRNFSLTQWFKSWKEAAQSQRLIYPPPASQFTTQNRIIDTYITNKQELYTYLSVKPPLLLNFTFATKENNKVTQALFDVLSDKSKYPNNEPVYLVNILADSEGGRELMLDYVVGSKIPSIIVLKHQLPSGKYVPDLETFTEQDLIEWLKHI

SEQ ID NO: 27002 - protein, 72 aa, Candida albicans
FDLYFNIYTYFFSVQFIKEVIEWVSVAGEREYLAARGKRDQDSFLGSSLSYSHKRRATIKVGPNGLEKKFFF

SEQ ID NO: 27003 - protein, 73 aa, Candida albicans
PDFSKVQILLFHLLHPKKKHTQKHEWSINESLNTTVENTIFGVDLKILLNSTLNISDYNINLAFLVDYHSTKE

SEQ ID NO: 27004 - protein, 67 aa, Candida albicans
SCCSNKLFVSLSRTTIHNGILLTKQRQKQNISLHDLLKRRKKTTKINPFFLVIIRNYTFFLLVFAYH

SEQ ID NO: 27005 - protein, 65 aa, Candida albicans
PIIQNFSSSKDAMKSFQNSLLIQTVPLMIMTVLSCSSTETKLYTQYKICVVFILLGDRAGCLIEQ

SEQ ID NO: 27006 - protein, 65 aa, Candida albicans
  UNSURE (25),(48): Identity of amino acid sequences at the above locations are unknown.
KIRKKKKSREFCCLSKEEIMGEKIXYQYNFHDILETRDMGCSLLLLSXLQNLYSNQHSKHKGFYF

SEQ ID NO: 27007 - protein, 63 aa, Candida albicans
SKRTIIYDTSFNFTIIFYLLYLSNQSNTLISIQASWRCLKKDSKRICTTTRITEIDYFATKLT

SEQ ID NO: 27008 - protein, 100 aa, Candida albicans
KYMNVEISLILQREEEEGTNEKKKINPILLINACSFTSFFFFFVFNKETSQVLFHIFFSFQYFFLLFSFVHISISFFYRQSQLSSTIRTQKFSLFLLAVF

SEQ ID NO: 27009 - protein, 63 aa, Candida albicans
LIKLLLEQKKIEGKLENLKIKDLSLFILNYSKHYLIYTFLLPKMLLVFVKVLLNWTVRTGYWI

SEQ ID NO: 27010 - protein, 88 aa, Candida albicans
AVVAVNYDGFVGFVFTGCQHKNKKYTITRTHLSQLVNFLSQIGFLALQPAPALRNFCRSAKPETSTNTPSNEQQRQQQTKLPAITKQN

SEQ ID NO: 27011 - protein, 67 aa, Candida albicans
YFHTDHSLKNLKSNSFFFLKIPNNTKTKKEKKFLELKRATFSITIKTLYPLHYTKTYRQTTDNRQPA

SEQ ID NO: 27012 - protein, 116 aa, Candida albicans
KLDFACAIFFSPPHQKFINFFLCPAVQIFIIEWRNKQTNYPFVDFLIRYVNAEYSSHKFNFSFNFIFFSGLILVSILQQLDWNHTTNFKYSRDTKKRKEFKLFLNILVVYCFKYRK

SEQ ID NO: 27013 - protein, 62 aa, Candida albicans
RMVLITAYHRKQRKDATDSDGISKFINLNFFFSFLKFLSHNGIFLHLIYLSAMRFVYLQQVN

SEQ ID NO: 27014 - protein, 62 aa, Candida albicans
HLYPYLSTNMRFSQHFSHKLRLYYYFFFLSLFPEFYIHETELERFKKIEEYIYSFDKTKESK

SEQ ID NO: 27015 - protein, 77 aa, Candida albicans
TFDVEERKKLHKQSLVSSTSIGSNSSSGSNNNLFKTIQIFFLSLLTWSNIRIKHQSNSNLIDYLPSSHSVDVPFTDI

SEQ ID NO: 27016 - protein, 84 aa, Candida albicans
HGTTLKQQIDSLYFYLIVSSKLIIIHSLFSFLFSFKTKFEPIYSHYGAISSSSAPASSSSSSSSSSSSSSASFLACSNKSSEIN

SEQ ID NO: 27017 - protein, 233 aa, Candida albicans
LLPMVAYRLPSPAPSSTNTTNCFPHNNKRKNSLTFHDDTNTNANANNYEHYIDDERIVKNLTKPDQITSETEWPQFIHPDGGIIKITPWGTLRQFVDPKTNETITKFEDCSLEDYSFKLESIEKLYQTPNTPQSIYHNAGQDNIIHTPHNGNRNLSGLIISPESEVEGYVVDGYRQQQQQQQQPQQQQQQHQQFHQQRDCFVPEHENYFGMTDDTVKLEDEIDSSFNIDEEML

SEQ ID NO: 27018 - protein, 84 aa, Candida albicans
HSNLRAQKKDHSFKTASLVALISKSTFLRALKFKTASLVALKFKSTEKRAHTFKTASLVGLILVGAHNEEQNRGYTIDEEVRHP

SEQ ID NO: 27019 - protein, 95 aa, Candida albicans
RPHVGDHFYNSPNFGDIAKLRVSEETREALVIRNLVCRSVALIYVEFWGVEKTGIFWARRKKVDLPVHDPKKGEFLKNGEIWGKFERVWSNNDKG

SEQ ID NO: 27020 - protein, 88 aa, Candida albicans
DHIFFCWKTAEKRAHIQNQAHTFKTAFLRPHFCHVSKTASLVALISKSTFLRPQKKEHTHLRAHFCHVNKTACLVALKFKSTEKRPLI

SEQ ID NO: 27021 - protein, 88 aa, Candida albicans
PRFCSSLCAPTRISPTKDAVLKVCALFSVLLNLSATKDAVLNLSALKNVLLEMSATKDAVLNEWSFFCALKFECYQTCGLIHVTKMCS

SEQ ID NO: 27022 - protein, 99 aa, Candida albicans
LFAFNNFHKHPDFRLFFGRFFRKINPKKHNLNFQNNANLIKTDPTTKVYHPLRCSPCLLISRHCSFLGQNFRKTKKPTRSAQQGAPKQTRLAALRFTDV

SEQ ID NO: 27023 - protein, 626 aa, Candida albicans
QNLLAKKFLPSFFRVSICMDLAEAIKAAHCRMEETLTRGSELSKADQALLDLLDYTMGYVESILPEKWPSMLNRLEGASTKFILKSTAALGTDKFTGNHTNLQLAGDEITDIAEAEEQIEKHLKVDLVSMMQQQLNSEMEDKKKKAIFKAYIYASERDLFRTRFLANEELRVVYDTTIQKFRELFPSFTVRKVVEQVIGYFPTFNDGANNMKVFGTTYDNVGLFKLKHPAEKWNVKKCIKMFFNDDKSDYSDELLRLAYLPATDYNIEFTILDSEVHNAKRGTRKAYSSRKSTHSYFLIGYNGKSVPKQTRYFLDNHRLTLCSTTKFCTACRTIGHTRWSCVNSSSCLKCGDPSHSTGHHNAWYDRQETDNQDNNDGYTTVGKKRKRKRKSKSNTTSTATANTATATTATANTATATTATATKATATTSTATQATTQADTTKAVTTQATTQADTQPSAIQATTQADTQADTPPSAIQANTQADATEAVTTQADTQSTVQTLDKNNTQKISKVAPSQDVEQLDEINTPSWLASQAMLPIPEAPSQEVELNEGPDKLLFDENEYIETHDYFEPSDFYKSGDDDDYMDEDSEEENSEEEDSEDDDEMSIDAVSENEIDDLQKENENDQY

SEQ ID NO: 27024 - protein, 76 aa, Candida albicans
KRGQNSSHLNLQNIKIVATNGLGVSQISIKAALQKKSDFISRSYQVYGYYALLNIENKQNTVEKDYCIYIKSKLLL

SEQ ID NO: 27025 - protein, 72 aa, Candida albicans
IDVKITIRVVYWKKKLVTIALAIHFSFLLVKLSSPHHYFSFPFSLSEKVTLAQNELQNAILNCRYYYYICLK

SEQ ID NO: 27026 - protein, 63 aa, Candida albicans
LFCGETFAGHPTSPTFYLFCFHCSHTHTPTVTFTQAEKDKIEEEGKTKNKKKRTEKREPRTQN

SEQ ID NO: 27027 - protein, 76 aa, Candida albicans
FYSLTDCLFRTSSKYPRSGFIKKKTRSGKMNRCENYNTCRVLEEEIGHNSIGNSFFFSFSQIVLTSSLFLLPLLPF

SEQ ID NO: 27028 - protein, 100 aa, Candida albicans
PCISLPGFLKIIEILQSIGNLASQSRQSKAIKENLISDVKQKKVKYGNKHNRICGDARNLFIKIFHFVALNFIQIHSKFSIVILSHSLLFLGGVPAAAPT

SEQ ID NO: 27029 - protein, 68 aa, Candida albicans
TGSNLEGLVPNINEMVKSQTQAKKQKAINTPTIEMCTGWKFLVLNMATNTIPNCPIAAQIILAMAKRG

SEQ ID NO: 27030 - protein, 78 aa, Candida albicans
NHDLNFQASSKKQKKQISKSMEGRSNRERQQAWRKRKEEEKHEIVIIASNYKKIVIHLAGLSIVELDKERAENNEIDV

SEQ ID NO: 27031 - protein, 65 aa, Candida albicans
MTKDYNREFAVYLNEIQSNKVKNFNEEISRIATNSIVFISVFYLFLLYIRNEIFLNCFALPALAC

SEQ ID NO: 27032 - protein, 81 aa, Candida albicans
LQVNHSSHYIINNSLNYKYVIKTTYSFPSDTLLSHSNNSTNSMVGDVNRHVVMLGCPRPTNLFIYERRIPKPSIHFRYRCH

SEQ ID NO: 27033 - protein, 62 aa, Candida albicans
AMVDSIFVYFWGQNIYQFLQEKKVLKDLIKIIWDKLNFLLMPESILQKSHDGQTNTLILLIQ

SEQ ID NO: 27034 - protein, 97 aa, Candida albicans
RVFLAKESAYLSIQATFKLLLTFNIRILQYLEKILLIVVVVAFFSFRATIFYRIEYSIANTRVVIANFKILAFGTKGINYAKREGPVNEPINEGNHV

SEQ ID NO: 27035 - protein, 75 aa, Candida albicans
FAFNGWPKYTWFSGHKLFVSFSIFNEHLQRGFLSVIQFNDLFLSTEVYLKRITGKLYQNSKLNLSSSSSSVGMAN

SEQ ID NO: 27036 - protein, 187 aa, Candida albicans
EKKRKKKNLAIYLQPKIIVNMNEDTTQLSIQDETFLDTACQRILSLDIKGSLFGASCLNVETKTLQIYEDSQINHPEVYIESLVDEFNPTIVFISSRTTTTVVSLLEDIKNVYQFKFYIKIVADFTKFDTKRLVESFYNLENNNTVHMFSTSALKSLNLRIAVCIYSSRSSGFLQRLTFPHISVRHN

SEQ ID NO: 27037 - protein, 62 aa, Candida albicans
HQLLRIMWLGLMSSIGCKHNHLLFQRIAYLLGIMLKIGEKRKKKVLYRNRKARKIKRIEFKD

SEQ ID NO: 27038 - protein, 69 aa, Candida albicans
WVLCVDLFENENKIIIQDRDNLSIYSLSCSSLLLITKIHWRLHMALSQHCIPLGFRRKAKGLADSNFKT

SEQ ID NO: 27039 - protein, 544 aa, Candida albicans
FHNYSDSLISIREPLVNTMNDYGGLGIVLEEAENENNLSNLSQQLKQQIQQKHTSISSRQSSIVSLSKTISRKTSSASLTQTPASLTTDNERLPHPEIQSQQQELDNENDHDNEEDDEDDDDDDDERVTRGSRKNSASKITTEILLPPLPGALEDLITTTPVAVNSFTSNGCDDSVSTGSDNTSHESFNLGEFNQIYQHSKSTFSNSALNSPNLLLNQTNLHVFPSVSKNGINDFSTSSNGGTTNNVTTLPPPTTNTTTTSTGNEKTSPLKRLKNGIRKLSLTSITSSNNSSSCSTPTGAKFYANTTTTTTSPANPIPLRPILSPIQVVKPPQPLHSVSSSTSADSSFSSKFERARASSQGTTIFTPVTPPVTTSPVITIGEDLDCTKRTLSKIEQSYFDSLTSQTVNSIEELITVEDLLNYLQYLIQQRTALDDVFQKTKEKLQASGWCSNHDLNNLQLQQDSSRCQIDTSLLKIEERLNREFSCSVLGNNTPTNLSKSGSTTATHSKQNSITKSLAGNDSREPMVSPSLKVLESRCVSFTEF

SEQ ID NO: 27040 - protein, 62 aa, Candida albicans
PPPYNQESLKIYHELAIQEQLPRLMMTILDRDCNTCLQDMSRLILLDTPSNILLQCMSKTHP

SEQ ID NO: 27041 - protein, 64 aa, Candida albicans
LLLIYPNVKNCSLEAQLKHIVDKETNSPSEQRNSSLVESIKYPFYNVNLSVYRHGSRFAIVTLT

SEQ ID NO: 27042 - protein, 80 aa, Candida albicans
  UNSURE (11): Identity of amino acid sequences at the above locations are unknown.
VGAYRSAVMKXFMFCLHHGSGFRYSYINENENLYYYCDDLSSEKIFFFHFFEAIYTNRSKKKKHKNNLKNPPHFNFVKKV

SEQ ID NO: 27043 - protein, 69 aa, Candida albicans
HKQKKKYYYQLMFSRFYTNLIMRELFFFEATLFSADLSSYETEQYLALILKIPYYFYHSKCILTINCQM

SEQ ID NO: 27044 - protein, 82 aa, Candida albicans
MQQSPEFIKKSRSLMQKVNSLESFTLNRKEKASRATSYYFVYSIQFWFFDTRSRLQKQSPNKKGVQKQFNFSKKTQPAFRNL

SEQ ID NO: 27045 - protein, 74 aa, Candida albicans
VNRPLFRYSIQICSSSADSLSLSLSKNIKNKMYRKYPVIIVQHSKFVIFPSDSISRNKIKTINTITKSSISIFG

SEQ ID NO: 27046 - protein, 68 aa, Candida albicans
YSGYQRYFRAHVRLEWRLLYSIQPKQVFMLSSGFYMIRLKNLFSQVLSGVKPKWYKNDKDKIQSPNCT

SEQ ID NO: 27047 - protein, 210 aa, Candida albicans
SMAETNPNDNSPKSLPLRRHSDVLVNTGTTYSATTPNSLNEGNSISSHRELIIPSSAGGRQQSPVLDLVHPISSGNLTTTSQETRTRNCISWCSGLFNFRNSSQQTAENLSLLPVYHVRSNTSPTDSAGMTSNLSDFIRRLLPGLARDRYPNTFSWLLATLLTIVLIAATLGLYFSGNLLGLLVLFRALVCSVFRQFQPSDVALPLFCRS

SEQ ID NO: 27048 - protein, 230 aa, Candida albicans
CQKHLLSLRSPTKKKYWYAKMFRSVSLSSLIPFLIIVLIAMQRPENDVPMIMQSSWLVNEVIKSINSNGQYINALIKKDFQPTVLPVSFILRILKFTATTDSKDITAVLADSTHKIFAIFLFFPAIVDFENKYHHRMTYNTRSCLIRIHKANLKFMDKSTVKKCYGRKSDGGLAIAVLEVLEFDIFFKDQYLFINSIENRLKYVYDDVEYNQLCGKKKHKPEYEDLMCDI

SEQ ID NO: 27049 - protein, 85 aa, Candida albicans
FFFAFFPTRNIGLEMMRDRSEDFLLDEKKGRQFTRPHTISTYKDFRLWVSIFQCGFESSIREARKKKRKKNFLQYQVVHIHFRDN

SEQ ID NO: 27050 - protein, 84 aa, Candida albicans
RRLVGTGKGGQKQQKADGNPKGKGYKASIGKTGDKDSVPAGAGAPAGVDSPKGKAEPVPDVEDAAAAARLSNEDTVQQIIEDTA

SEQ ID NO: 27051 - protein, 101 aa, Candida albicans
TSRNQPKTTPEQHFKVFELKFRAKPHQKTTPSSDTWCEQPPNKKESTKRNHTTDKVTLRSPCLQLQQSQSLTIYRQVAKKIKLQCGESNPGLLGAPFLKKK

SEQ ID NO: 27052 - protein, 72 aa, Candida albicans
SLVLINVPNGHISTRQPMIKSSLIQMHVKFTASSGQSWAISLIQLKKQAGGVARIDLRNTKAMTNTSMSLWI

SEQ ID NO: 27053 - protein, 246 aa, Candida albicans
SFQLLLLFLIHLNILAHMQGSYNNNGLPRPYYMKPSKKKLSPYSNLKEPIVYFNNPKRKLVGYIIMFSLIGILMWWISQDFKGRPEVEYELVKNEKSGEKNTPMDLKNSANLDKIVNAVGSKADKESENLDLAENLSEGSKGQKGIGVTEASKGGITNEAPVVGLDEEDWLVLVRVDKNSKKLMGTQRGKVIKHLLERQVIKILFLLVLALLLVLIAPREKLNLYLMLKMLLLLQDYLMKTQFNRL

SEQ ID NO: 27054 - protein, 184 aa, Candida albicans
  UNSURE (154): Identity of amino acid sequences at the above locations are unknown.
FESPHIPFTHIMIRTSIRRVSTKSIPYEPIPKNKYNQVRSAYNFKPAKNDGFVYSPPAAIIKPHMITPYIFLPENDPRRELAKQHRIDPKIVAEMPIIRQINAPHERQYNVDADTINKIKELRAADPERWTLKEISKEFNIEMDKLHFFLRSQXPKKPTEPVKVVSKKLLDRQKRKQLWLRNQY

SEQ ID NO: 27055 - protein, 70 aa, Candida albicans
IKIFPILTERQQSLNPISIDSPARTIDTPQILPKNLAPLYSYPPWHFIIASSTGNWFKPSSTNKRMILSE

SEQ ID NO: 27056 - protein, 71 aa, Candida albicans
PLINHQTTLFNIVKRTPLSFEMLSHILTTIDTNNYTNFGVPVIFYHHLIIAISHVLYFIRGQQRCFSGPIV

SEQ ID NO: 27057 - protein, 62 aa, Candida albicans
GTNKGAAQKSNNQPQYTGKKNISMANIKNTLAVELISNNTLNAFLGVPEIGFGPDTKNFINL

SEQ ID NO: 27058 - protein, 184 aa, Candida albicans
LIFCGGDVKKLNADLFPVSVKDLSLRKMRIQKLSDSFENLENLRRLSLEGNQLRKVDPVKLPVSSLQMLNLNECNLRLISPFLVSMLEQKNRNPKLKIIAWRNTNVSVTDIRTALKSIKGLLLDLNDFDKTLTEISKRSSRLVCKGGFFDPRFKKTETDDLYDGSESSLDEEDVGGNAKRRREM

SEQ ID NO: 27059 - protein, 60 aa, Candida albicans
KPLKKEEEKYPELVITVRSENTNAVGLHPVIYVQRNKLTVFLVLWTNGQPRGRKFTSHLR

SEQ ID NO: 27060 - protein, 87 aa, Candida albicans
FAMKCSNNLQPHIKKKARSEDIEKNERKKKNYDEMKNTFIRSSIILTTTSSLAPWPKEKQQNRNLYRLRSQQNLFLKRQSQYVYLQQ

SEQ ID NO: 27061 - protein, 65 aa, Candida albicans
NLFDVYLTLNFIFYRNLDFSYFNFFLAFESLYIYISLILLYRQELLLYGKYFTLKKLKVFGQLNN

SEQ ID NO: 27062 - protein, 108 aa, Candida albicans
HCIGNFQTEVVAPGVQQHTRPPRTLRNRPATFSCCKKQLFYTQVQALHNQGFPKINYSVHKRSFSLEVMIVRKLISLLMHIGNFEKKKNFIAEPELCKVEKISQKKNH

SEQ ID NO: 27063 - protein, 66 aa, Candida albicans
NKLHKGDLYVAFLLIINQWCVAKWYLTRSIENTPKTYRSQYELSVLIKPIKSESSSIKSCWRHLAV

SEQ ID NO: 27064 - protein, 70 aa, Candida albicans
IKYSAETKLATTSRYHNILKLMALMGLIIHFQKDLNSNKQLLDYLGFVLYYLGFVLYYLWCLKWLYLIVY

SEQ ID NO: 27065 - protein, 75 aa, Candida albicans
IITVSDVPQPKSGLATGTKSTLFPKPAQLFCCVKSQHIKLEATEETSRDSTNETRNEYEYLSWKNCFTVFLYYLC

SEQ ID NO: 27066 - protein, 64 aa, Candida albicans; identical to SEQ ID NO: 23307

SEQ ID NO: 27067 - protein, 353 aa, Candida albicans
TIHKVRARLGNHHDTLFKKFALYCTMSEVPKQESPGSSILKQSNASTSTKIRGAPSSSQIANVDFNTLRKLNTNTSFSSNLTNSTTKTSNALSRLFTRNKSSSNISVHPSSSDDDSSPKTLREFTSPSESSKSVSGNKLRIAKKLKFPKNQSSRKPDLFSDTSSTISEDSSSFRKVITGNLLNEMNKPRKSSMSSPMSTTFHSLFHRSHHNGSNLQRDTNQVATGTTPLSGKFDDFSKPSKTTLCLSSNSSNSIISNPELAQIYNFTNPNISIEDGETNLDHSNSSFLDIHKKMLVPADLFIQNKLNKYHQTEVGLGIYESELDHDKDNKIYSNLYHYLKPLFTPSFSISDSG

SEQ ID NO: 27068 - protein, 183 aa, Candida albicans
KGKMRPILGASVEEIANFVKESFCLHQPNHERSFRLKTRSSVSSLDREKVEDFDYRQLSNLFEKLMALLSHNLQTADSSEVSLQALILNAWKYYNTYVRFYLLSIFQPLQLHLNELSMRNHNGSKIIRIDDLLLVSFRKVFITEQGIGSGDRETSQFLRNTESEDLTGNGLLTSTLAVLSSIS

SEQ ID NO: 27069 - protein, 137 aa, Candida albicans
VQSGGTRATAGTVYPILGYGCAGCQRLYHSLVPTYILGTGLLPPLARKSGLAGTRAGAEIKLGPEPEPEPEPGPEPGPEPGPGSEPEPEPEPEPEPEPEPEPGPGPGSGPGPGPGSGPGSMADVPKLKGNGQSQSRV

SEQ ID NO: 27070 - protein, 65 aa, Candida albicans
FIKEVILSNCQMKTIKKDAKTQNKIKNMQKCKKNLKKTKQYKTNYKQIQYKILKIEKRSKTIKKK

SEQ ID NO: 27071 - protein, 61 aa, Candida albicans
SHYYTQEKCKTCRNWPEKLITPSPVRQTKEIKLISGSYLYTKFFNSYIVVCFLSINYEDLK

SEQ ID NO: 27072 - protein, 64 aa, Candida albicans
IAQHVTSANGISTIFCRALKKMHAKFEHDKKKTTVTDTHQPMLEEDTSSDRVPPTKSKCICLWC

SEQ ID NO: 27073 - protein, 109 aa, Candida albicans
CESQIVMSNAIDFGFVDDSEEPAVYTTFLPRPISALARVNLVLHEHPVVKYKTITRVRGGDEPLMSGEEERYGTEDERDTEKPLVEHNYDWSLQYLPGLQFGVVSIRRN

SEQ ID NO: 27074 - protein, 93 aa, Candida albicans
  UNSURE (66): Identity of amino acid sequences at the above locations are unknown.
GKLANESWSFFIKRTHIHHSLIHIVMDTRKEREQVWTATTTALKMKKSSGNGSNKDSLDVSGFEKXKLPPRVQLISNTKAISATNPDLIFQKA

SEQ ID NO: 27075 - protein, 62 aa, Candida albicans
RQVKRNLSIKFHPEGSSSEMVLNFPKIFWTPSDVAPAKTYQEGGTSEWGHEFNLRMSNCQQE

SEQ ID NO: 27076 - protein, 119 aa, Candida albicans
PLNTWTVVVFSQFLVLPVVPFITKFNRYIVLGLLVVGKFGNNFKAIPDGFSKEKGNYIYKEYHVGYANGSGVLLGGYGAGLPGGGALQSELGYVSEQREGISRGSEACRCIERHLEWQD

SEQ ID NO: 27077 - protein, 73 aa, Candida albicans
PQFNQFDTLSNEPLGNRIVPLRFTPVKECIANFNECINWMANLNNCTINLELSSQMSNSEFEQLPEPKTQPLI

SEQ ID NO: 27078 - protein, 60 aa, Candida albicans
TELSRDSNDYLFTNNVNVLDTSVVESELFLKVFIPSNFLVRRYNFSHFGKNFAVLNQTSW

SEQ ID NO: 27079 - protein, 62 aa, Candida albicans
IKLKLVLQKTKKNGKKKVKKENISIQPMRFKQSIPHLMQTLIFRRLGKIVIFFFLFCIVRYI

SEQ ID NO: 27080 - protein, 71 aa, Candida albicans
LIWLFLKIKNTKNDNRETQRRKREIDSMLSCKRNGFAFIFYGKSSISFFHLSEIELLFWWWGGTRWQRLVD

SEQ ID NO: 27081 - protein, 71 aa, Candida albicans
QFDKLSINSIFQLLLLSQRQPTIWHIFALYACNPKRTSASSSVSTAYLNLHRIANKPADFNVLLIPHFGYF

SEQ ID NO: 27082 - protein, 60 aa, Candida albicans
YELLFFSQQLALYLYKNKVKSDNICKSTSFFRPMLSDNRLTMCYKNSLSTINLQFDSLTS

SEQ ID NO: 27083 - protein, 74 aa, Candida albicans
IIALFAVIGDTFWWQMRKTKKYEQIWIKISAKKYLRLLQHQSLVFNITHRCQHHIYKEGNSNLVHTYNQHKHKH

SEQ ID NO: 27084 - protein, 73 aa, Candida albicans
QLICRRCRKNYSFFGYCVIVTEVPSTTFCILLIYKLYFIHTFVYLILSKFSSINYKQLSTILLFTILACTLSD

SEQ ID NO: 27085 - protein, 69 aa, Candida albicans
CRTIITPQMRSNTRNEIKCRFGHDNDLSCHVAQKQKKLDQTNTNNKKTLHNQHILSSVLIQSYIPNVKA

SEQ ID NO: 27086 - protein, 70 aa, Candida albicans
ISFGVTGTQTSHEIASLTGTDHKPVCGVGHLPPNNTILVFMFMLVVCMYQITISFFVYVMLTSMSNIKNQ

SEQ ID NO: 27087 - protein, 77 aa, Candida albicans
YIFTSEKKKKKSIIIIITIDLKQPILHQDMVEKQFNIDLELNDTGHIDPFLQDEYVCFLTLLVFLVLFFSLLTLTKR

SEQ ID NO: 27088 - protein, 108 aa, Candida albicans
DQFSANNGIKSLRAKEINTMEAIPSNGFVGVSLINGTCIACPNNTMKPVIDKASGSLIKKKDMTTKAKTLMYNKILADKNCITIDYLMERFMGANEERKLTIPLKKKK

SEQ ID NO: 27089 - protein, 72 aa, Candida albicans
FYATKPLICWTSTYNWTTNELFVNLIINMTIIRFETEHDFKNNVNGINVLQLGFSDFNEIEECLDWSIQNFV

SEQ ID NO: 27090 - protein, 78 aa, Candida albicans
LFDGKIYGSKRRKKVDHTFEKKKIDQKQRVKKSTGMENACRVQTFHVILNLYKFIRFYHTIEKQSLRINLLTWNQRGR

SEQ ID NO: 27091 - protein, 64 aa, Candida albicans
PNLSEFKDVGLTNFDKCGEMVDFAKLGFTEDINKDTKSKESWVSLSALFIFFDNSNLCLLNTSC

SEQ ID NO: 27092 - protein, 73 aa, Candida albicans
YSGVATVNPLPSFFFLLMTRILYIVTGLYYSLINRFMKNEIIKKKPKLKGIKEVYENVSYNVCSKRVLLSGSI

SEQ ID NO: 27093 - protein, 93 aa, Candida albicans
ISPFSPQLEPTFSSEFLQTRAQNFPLLGNNLFPKMAKNVVASKKMAKNPHTKLKMTKNVAPPKKRWQKYVAPPKKSRIVKKKMTKKCRKIGQN

SEQ ID NO: 27094 - protein, 65 aa, Candida albicans
PRMSNFKRAPEQSESHTNKFRFSNNFLANTGHTPRVSSTSQTAAPQPYGCSPFFFFSFLGCLHPQ

SEQ ID NO: 27095 - protein, 63 aa, Candida albicans
IPNLTKVRLNGEELEFIKNSHLTKSNEWTKLQKAVQKNFNRLRSRELLRNRFDTHKKMTLSPK

SEQ ID NO: 27096 - protein, 78 aa, Candida albicans
KICTHREPGISIKRREKKGIYDIETEFQSTLLVGVNFIYSVFCLLKINAYRVPGLILTNIPCIQTVPFTLFAVPLQRP

SEQ ID NO: 27097 - protein, 70 aa, Candida albicans
HILCSKLGCTTWLIMKNKPALCNSSDCTEENNTPIYSIDDGISGLIIHMDNSVHCERNFFYYIKGRFHTN

SEQ ID NO: 27098 - protein, 62 aa, Candida albicans
YYHAHGFGFRLNISLSKHGKLTIFVVYELPNQGKWQNITPRNDETANPRIMAQVSKVSKRCC

SEQ ID NO: 27099 - protein, 79 aa, Candida albicans
RQVKRNLSIKFHPEGSSSEIVLNFPKIYWTSSDVAPAKTNQGGATGLIYGSLTANKSDLYVLATPNSKSLKIKLTLSIA

SEQ ID NO: 27100 - protein, 65 aa, Candida albicans
NNGGTIEEYKIKEKPRNTKDKYKKIIGGHTLCCEVIEYTQLLFLGIASFADGDQEKQLKKWLDQY

SEQ ID NO: 27101 - protein, 200 aa, Candida albicans
TNKKPINATKPKKEVVLATLTAPLFSVVRTEGFSEAEEDGAASPVEINTVEAVLEAAEAGAEFAGPLVVPAAVETDADVGTETPEELVTVVLSPPLVPMKTITEALGTALDFSLDEEELEEEEEDDDDDDEVVDEGELDEELDDAEDVLDESEEEADGLDELSLESTDCPLSNFLISSCAWSYLPLTLPPSALMDSQEPD

SEQ ID NO: 27102 - protein, 106 aa, Candida albicans
MLLSLSIYFEFFLSKSTDEIQAELYMPIFTNNYYSDGYIELKKKRLASKGCNDRFRIFGGGTHQCDLNRDTPRTIHPSTTNTQNAILVRRQKKNKKKKREELINFI

SEQ ID NO: 27103 - protein, 177 aa, Candida albicans
LYIPKMIQKFTCVPATDYDVIVVSNGTESQIKSRVTTAKTARITYLHDLPSLSSYLSEVPNFTGKIIFMFFDGVQYIQDFICDAIDLYGKTPFSLIQNAYFYFDKLDPVNLDLQFNTVAVIVHDVLKKSNYMLDRIRGVYIDDLLLVGDRSIPMKRLICNFPNVEKFVLQSNAKITF

SEQ ID NO: 27104 - protein, 90 aa, Candida albicans
DSCRDRFTTQKITNDNSITTTNDANVMEDMIKNVTKSSSEVSCPFECLNGGLITGCWSSSPPLYCVKIVGWALVNGAINNTDRNIFEYKL

SEQ ID NO: 27105 - protein, 65 aa, Candida albicans
INKKAIQYYKVEGKGSKLKSNKPLSIQSQPDGEIGDTGSHDKFSKSYRPLMLSPGIAPSCISSAL

SEQ ID NO: 27106 - protein, 123 aa, Candida albicans
DDDIEYEGRHDSDHINLTEDEFEEDISRTYFDSTDSVKSNFFQTHKFKTVPVYCSELLLLEYLSFYSPSFSKSILKLCIFCFIGLDIFVVERTKLRTMLFLLVSVVLSILLAYELGHLNPYIV

SEQ ID NO: 27107 - protein, 223 aa, Candida albicans
HIIIDMSLQIVLLLDPLETSGLTSNNVREFLEKCQVRDIVFFDESVLGYVVHEGSLDQETGFVQCEVAILQLNNVEEKDPLNYVNLENKISLTLGKEELVYDNDLIQIWKFEIPVTYPRKRLNNPKLCISCSLVNENNETLVVENESFLEETLANYVPCMKRNLLAELDHQIDFIDTSNDVLETGITVQENSIIDKPNVRAFISVPVTISLVIKLKSTKRPHH

SEQ ID NO: 27108 - protein, 109 aa, Candida albicans
ILNMYTSPKSSPAINMFDLSNQAKQNIHFPSLLVYSETTELLCWSIKMIFPPAVATKIQYSFEQETAVTKSSLEWLICVTLLSTPQRYIFEPSPTATRFVLNDQLTRFE

SEQ ID NO: 27109 - protein, 66 aa, Candida albicans
KTHFISDNCTPRNSNAFWLYNITPIYMYIKFKLQNKPQNFNVFTLKNRIDNVTTYQRTSTENGSIT

SEQ ID NO: 27110 - protein, 67 aa, Candida albicans
LESKIRKKEGQLKNNIKENPEKQTNSILLCQATGKLRRMNKKVNYEAMLVLMEDLLAIYVLIKNIIH

SEQ ID NO: 27111 - protein, 105 aa, Candida albicans
LKNIGKYMVISCNLNEAILSYGGMGVRRGDFILYYQQLKLKNYTILKYTTCNFIWLKCKIYDFYAVSRWFSLLYTVPIVLRNVRSSFSSTHSPSPPPLDLNSLEF

SEQ ID NO: 27112 - protein, 61 aa, Candida albicans
IKLTICRLVLFLFIYCFFFLVVFYHSFFFLSMVIDYYVNSSSCTSTYYITIQINKKQSTKY

SEQ ID NO: 27113 - protein, 125 aa, Candida albicans
QILPLSILTFTNNTRCLFFRAMDVVFHHGGINLSLFGSSEIDIQNLSEFPSLKYLKIDNSYLLTDNLIQKLMGRNKQSLIVLDYMYLQEIMHATLFEGNHVHKEFYDRNTGFATKVLTELNTLIQ

SEQ ID NO: 27114 - protein, 254 aa, Candida albicans
THHCLQMVLNIKKCLESNSLACMEQSILMLPHELIARILSMNYSMYGLLKHIYHFVVTCKEMYYRHVFLLYTLEPVMVSLCKCNKAISLVAMGLLKQSKLCYSIRCLDWFLTPKFTTAKHYQKAILDSINQFSNLYKVCLTANSLDMLMQVNRLPKCVSVLKINLITHVNPTRHTMRLDKVPLFRLKVLIFETLAPLSLTEYYYPFFRSILISKSPLYSWMAIDENVPEAHVKSPINQVCNILATLIYHSRFYP

SEQ ID NO: 27115 - protein, 61 aa, Candida albicans
NTFTILLSLAKRCTIDMFFYCIHLNPLWLVYANAIKQSALWQWDFLNKANFVTVLDALIGS

SEQ ID NO: 27116 - protein, 201 aa, Candida albicans
TPEQNTNNNNRFNFSIRIFVPNFLFFALSFHSLISKMTTKLIQDPTGFSKSFETTYPNDTSSSSSTNEFFFHIINYSDKQILNISINGLMDTTFELPVSTKSAITYASALEIPIDQFDDEHEQEEIREREVIPEPILLIGDHSNMKLLIVATQISKLISNNCPKPTILSIGSKWFGKGDEVDDNDFEKLMFILANVKTLIQ

SEQ ID NO: 27117 - protein, 100 aa, Candida albicans
  UNSURE (90): Identity of amino acid sequences at the above locations are unknown.
TIEKKIQILLIKLEYAIEDLNDYHRNKFIGIWEILLELRKKQVIDQSLWSRHKTSTNPTTYLFIHFHHMAVTIMNLQITFKKSIILTKFXSYCCKRSLRW

SEQ ID NO: 27118 - protein, 66 aa, Candida albicans
IFFLLPSFWYQTLRTREVVAAAAAIQQICPHTDMIGVPLDQLYNTNRNRHPHYKTVGPHEIAIHYK

SEQ ID NO: 27119 - protein, 60 aa, Candida albicans
FPTLWVSTKKKKTEGIIEPTNEGGHGPLLVNNKKKIISAVFVIMSTRCTCLMLFLCVMSP

SEQ ID NO: 27120 - protein, 90 aa, Candida albicans
LVYQCSSKKNQVVETTTAFELLGKIKRREGCFTKILGTFFLCNSFYILFQFVLHLVVVFFVFIFTFLSFIGYLFFLLFIISNAFSIEFVV

SEQ ID NO: 27121 - protein, 63 aa, Candida albicans
HKTGNHHYYYCYSLIKKNYNNNNIIIITLLSSIIIKTIRFFACILSYIKVLSKKSKKKKKLIY

SEQ ID NO: 27122 - protein, 91 aa, Candida albicans
EEEIRKENKGREESKKSKHGKLKVDSSSKIDKEKKKSKKKSKDGILSKEKKRLKSSKTKKDKDTTSSKDFKKKKRKFESNDETTKSKKRKI

SEQ ID NO: 27123 - protein, 115 aa, Candida albicans
KRTNGYYRLKKEKLKGFQKLWLSAVVQTLYIYTSFFIIHMPKFHCQYELTFEVKRITCNMFKPVVVFFLFYFRIMFDTISAKQAPKKKQTNKIFPVTIVSHMHTDVGRSWSKKKV

SEQ ID NO: 27124 - protein, 88 aa, Candida albicans
RRIILFIYINYFSIFNMPPAANRTRKRQRSQLATEPQSEATALATTSPNLPTNTDANDEVILESPQYTNMQSHTNDHNNERNFIFQQL

SEQ ID NO: 27125 - protein, 67 aa, Candida albicans
IYYLNSLRTFRIETFQGDLGQPSLLCEKDKAVCILFSLSNTALNKKNFKSIGIQYRILLFLFVTNNF

SEQ ID NO: 27126 - protein, 473 aa, Candida albicans
EKVVDEKVKIDKEDTPTGTKINSLSKTKNLKNSNTVIDLNDNDMVVDPDEELVPGITKSSGLPNSNVPTTDANNSTKEESSILKDLDSFVSFEKSPKPKIAEIQATSTSNNSRISFVVESESSDNDSYSNYIQDIKQIDDEILKVMLEDSELHSLTKVDTNEKEESIMNDSNYEDSEKKSIKEQDPDGMDIDASDLLVEEEEEAEEELIIDSTEELQSNQKASPIRNSSEMTAGNDRSLEEITGPNDSPPKVKNTDTYYSPDNTKELPSKSLTKASELDITKNQEITKEFKETKVESSAITKKHSLEIDEKHYPDVLGIGGLATSPLGMNSSLTEIHRLNNNNNSSNENDNDNGGVEEEEEEEKKKLQPSLKWQLRSMSQFIEQTKFLESSANELKDLACSEYDLHDDVTGDLTKFIAEMPEEEEEMTIKQWIEHCAANCKDIVTQSCTEINDFILEEYDRAIKMIEEMPTED

SEQ ID NO: 27127 - protein, 65 aa, Candida albicans
ETTQSHNYFGHLTTMSSFVKGLFSHTRKSIDLTSNPLHTSIQIRTAKKKISGSKTNNKESARKIL

SEQ ID NO: 27128 - protein, 249 aa, Candida albicans
SHEIMKRNNSESQLLYYYNNTTPTATANPTANPTVTTLSLSTSSPTTNTIVKKFKTREFINKPPSNYISLNNASIIPINILQLLNSINPMNDDSTSSSSSSSSSCYFKFIFFLGAQGKEFIPTIQYQFPFNISVTFITSNNDSSGGGSSGGGSSGGGGGGGCGCTNDQCKQLMKFFEIKDPMGAGLYPLDYLIIIHQNKVHCKIPIKFNNNSTYTKHFKVVGGMSGHLKFGIDLNELPSLIEEYINYQP

SEQ ID NO: 27129 - protein, 185 aa, Candida albicans
FCSRPMYYAVPQRLYSISTDFMDSILLSDFEDESATIMSEASSISSMSSVSYSNHDSSEAKLRRIYNGSKNEIKESPITTKPIQYEPFTFEKPMSLTYKLNLIQSFFEKLNINTDNKVLKTAKYDFSGYEPGDLSFKQGDNIEILLDFQNIDTLYHSDELNWLIGVSRIDDESYRIGFVPNNYVE

SEQ ID NO: 27130 - protein, 69 aa, Candida albicans
  UNSURE (2),(19): Identity of amino acid sequences at the above locations are unknown.
NXHLRKERKKLCFSESVTXELRRKSSRNTNKVNYKDQLLSEGELEGEEKDHLLDDEVDSENDESDEFGI

SEQ ID NO: 27131 - protein, 62 aa, Candida albicans
FKLICLSKKQKDKEITKLYIYIFMKIRKQKKIIIIIIICKEMQKFCSRWKRLIKLGFGLEEK

SEQ ID NO: 27132 - protein, 60 aa, Candida albicans
KMTYLISTSHAQSICQSLYILVQFLKKKKSKYFSLINIYYLYDLQPIFQHYFSMLNQPLD

SEQ ID NO: 27133 - protein, 90 aa, Candida albicans
LLSQGSSFIVRCSITCGGIWYGGVSVSVTKKTESNFHSKRRLHKLLSHTTKKKKTGEDSISSIRFKILETSPKLIHLRFLLNIFPNTIQL

SEQ ID NO: 27134 - protein, 142 aa, Candida albicans
PSSPVVSTFDGLFLVVSGKKTSHSVVSNYRFQILRKQLALPRPIYYIAIIIDFILRYIWILKLFIINEELKKEKIKFIYIFSTFLFGYDAYSLGYALIETLEIFRRWIWCFIKLESDWVELYNDQDLLNQDIELETRLPKQG

SEQ ID NO: 27135 - protein, 71 aa, Candida albicans
HILSACWLMFLLLIKEEHFNSKIRIKMTKLLVKFFWYQNTTTQLIYGNKIFPTQCQIFSFPPSPSFRLVPE

SEQ ID NO: 27136 - protein, 197 aa, Candida albicans
NHQSNKMVSFKSLITLAIAATSVSSFNLLHDDKGFAILPPTNIVLDHLKEVGKKAVTTHYDVLNTIKEDGEIVHVNLHTHETKCTGKYAKDYDNSMYNKLNKKQLFIRTIEDSSLKQCLNKEFEAETSECGFEFIEYNSASGCSSDATKYSCLLDVMKQQDATKKLKDMDDVPAQVRCYHKLEQATKAEVVGGACAK

SEQ ID NO: 27137 - protein, 62 aa, Candida albicans
LIVGILLLIPPLSSNKTKMVRLVNSELYKVLLKREKENIFINPKCFKKKFFFFSFSHLFQLT

SEQ ID NO: 27138 - protein, 65 aa, Candida albicans
IIMPHAPKLSFAAIAVMSSVAVIYVGINSPLKNKWVSDNRISPKADLAWRNSAEKWVEDHKGNRY

SEQ ID NO: 27139 - protein, 76 aa, Candida albicans
FTKIFWGSIVAKNCSKLHAQVPFPFPFYHFNFLTFILYNNLNIQKQAVNNNNHHHLNRLVVISTFLIFSNTIHQYY

SEQ ID NO: 27140 - protein, 98 aa, Candida albicans
NSLSNRSGHKTLLLPIDRYPQFTSTIQSVLESKKVDYNPSYIDTIYEVLLKFKRSNTPYKLFHCIIFPSIMPQSILSFLCLASHSLHLKKTFRSKNPL

SEQ ID NO: 27141 - protein, 95 aa, Candida albicans
FILELRFMPIQMHFDILLSQVFSMLLFFFSLSYLFNKQSHNDISRDLLLPVPSEQAGILQVKVYVCASESQAVGARSCVGGSFAYQCVTVRRLVA

SEQ ID NO: 27142 - protein, 63 aa, Candida albicans
SSLKKKKNVREVFNLAPLNLPSPLNSATMLARLKFYYFFFRILDVSKEYEYITEPYRLMYILL

SEQ ID NO: 27143 - protein, 64 aa, Candida albicans
LRGEVLPLLPSTAENVIASTNVNPSRKNGFKMSRNSQFGKLSDNLKFGHNHRKLSYQSLAIHCF

SEQ ID NO: 27144 - protein, 103 aa, Candida albicans
ISPFSPQLEPTFSSEFLQTRAQNFPLLGNNLFPKMAKNVVASKKMAKNPHTKLKMTKNVAPPKKDGKKKSHPQERWQKYVAPPKKSRIVKKKMTKKCRKIGQN

SEQ ID NO: 27145 - protein, 112 aa, Candida albicans
NDELDKALSATRVLPTHLKTAIKAWIELNKPETRTPENDLYTTIDESYSPTKNYISKDFAPSTDTKYYNSSSKKLQLAKREVLTPLGWTERLDISTEQWKSTLEKLQQNGQK

SEQ ID NO: 27146 - protein, 82 aa, Candida albicans; identical to SEQ ID NO: 23926

SEQ ID NO: 27147 - protein, 120 aa, Candida albicans
FQVQSVCILTILFAMSNNQSYSLKNQLYKAKGEVLKLQRILRTSQNEVDRLNDNLDRVYDEKQDVIDDLESLKRRFSELKRNYEKISRQKEFYQRCYQNCEAVLNNDGSARKNQSLKGVF

SEQ ID NO: 27148 - protein, 66 aa, Candida albicans
YLNWKLDTREIKSLWKSHFIWKTYFEKDVKSVGTSKMEVSEGFQVYCREGATHWREFKKLIDRREN

SEQ ID NO: 27149 - protein, 93 aa, Candida albicans
  UNSURE (15),(16),(23),(40),(73): Identity of amino acid sequences at the above locations are unknown.
VRTEFDTFNQINPRXXTIDTLKXRKNIKIEKQLEIGYVGXCHPPCVLFVLYYFLFFFLFNCGIACNQFKVKGXKCVHTQIEALQFRLNYNNSL

SEQ ID NO: 27150 - protein, 63 aa, Candida albicans
ILSPNLNFLVELSTLSIMSDMSFTYPKTFTKEPNPEKLEQQLKNKKTGWKRSLCKNIVSTEYR

SEQ ID NO: 27151 - protein, 94 aa, Candida albicans
DKLCDLKNAVSFGFLFVPLFSNSSLSPFFFLSLAVLDLKICRRRPKIKNKTKQNKHQMSLTLNVVKRLAINQKHLSTHSRQGKAYHKTLPNNNV

SEQ ID NO: 27152 - protein, 95 aa, Candida albicans
EKKNSQHLTPLSTCDKYAIIKNLVQEWGEEEGPQIGGGVQSVSSGRADTNGAANICVLKDLGILRLIYLRSCSSRKSFSPFCNQLSVIKRWRIHV

SEQ ID NO: 27153 - protein, 64 aa, Candida albicans
QAYSTASNINSRPTTPGSRSLRKMPTVHGDSMETSSNKEKTHKVDTYNGNSINVNERDDDNSRD

SEQ ID NO: 27154 - protein, 73 aa, Candida albicans
MLGIFFFLLEYFLADCLLFWFSLIYSKLLLLLIAVFLFYLSIRFSFKNFALISIVPWSSSSPPPDTTVVQRGR

SEQ ID NO: 27155 - protein, 85 aa, Candida albicans
SYSKLRLLLLKLITFQSTDSEISKEIFQSTSLLASNHNLKRFVFYLFSILIIIAYTFSSNSFRVLYPNSFAHIPFFTRRSRSDLS

SEQ ID NO: 27156 - protein, 67 aa, Candida albicans
CFFFCVCNPYCEKISFGFLVVSDNLFKFHSNFNRSNLATINTYSISQAINYSINHKKADITKIKGTL

SEQ ID NO: 27157 - protein, 77 aa, Candida albicans
IACICSSVVYRKPIEVVDDKGVKGGYLYPSLSGVAIVRLRKSSAHWIGIVIVRITLQRPFFVHVYYTGYWKSVMTYH

SEQ ID NO: 27158 - protein, 64 aa, Candida albicans; identical to SEQ ID NO: 23307

SEQ ID NO: 27159 - protein, 64 aa, Candida albicans; identical to SEQ ID NO: 23307

SEQ ID NO: 27160 - protein, 62 aa, Candida albicans
LEMLQQKRPFFYPFFPNKFSTKNTKMPCHLNPLDRKTSILMPASSFKDQFEATCVGKKPLDF

SEQ ID NO: 27161 - protein, 64 aa, Candida albicans
TPIPIFNTWHIMNTIFANIISLPLFLVDSLEKVGLVSLKIAFIGFHNNINVIVTEITCKELPVI

SEQ ID NO: 27162 - protein, 63 aa, Candida albicans
SELLAMFLVIATGKCATANIMPIIIGNQFPYIPANITKRNPTDRITERPIILFKGFFWRYENV

SEQ ID NO: 27163 - protein, 542 aa, Candida albicans
IDMLTLPLDLILYISDIGNLSIKDIFHLSQANKLFREKLLHPYFWHMVYNQKIGKIYELYGISEPIPESNYYRLCKEHLRRFNEIERELNDFNESKNYKIRDYITKYSLDLVFLPTLLYFLRQEDFQIKLNIRNKSNTVEFSKGVFLANLVAGQSFNIGIKMLTKFSEEPLNSRSYESFWFAFSLLQKKSFKLIKARNLFLEGAAETLRKLTIEYYPLPLVDNKYTFKTVDEYSNKVALYTQLLYQSYCDIRCEESNYMESTNLLSMYSGRHKGDQLLVASSLIKVVDEELEALDIRITSGEDKPKLLLAPMGTALIGDYCVPFLAGHPRVLKKEKFLNVCRSISEPLANRALLPITKDEIQAMICYYGTALKFLDGLDVLSPPCHPSTYGDDTFTFFGQFILPCLFRKEVSNFNMQILLQNVRDFLVNANHIYYPIFSRLPILSGYSLLIEDAPQYLPCNYLPSLLQGKIVITNRSDAPAIVVGTCNDSLFYQVLNAYGELERLRDTSFTVVDRVKAEEVETFVELVGLANLIYVPIKGVI

SEQ ID NO: 27164 - protein, 84 aa, Candida albicans
HKLHRHWSIQDLHLDCHRTMPQNKKWTQGGLYTRPETMWKERGIRQEEPITINTTVTKFWVHDCDAITSFKMLSFSWHEQCIYL

SEQ ID NO: 27165 - protein, 90 aa, Candida albicans
TIITTFTINTFCLFLYNSFIIFFLIFLFFFFLQRLVVLVYSTLTFHNLFPAANTLASKSYLFQKISNFSNKKREIDKIFTLKLYTDFTTL

SEQ ID NO: 27166 - protein, 104 aa, Candida albicans
  UNSURE (13),(14),(16),(19),(20),(26),(32): Identity of amino acid sequences at the above locations are unknown.
NNDNIPPPPAPPXXLXMDXXIDLKKXLLGGEXTIPDFLKEDQSLKIYINVHGYKSVNNEKGSCGRNCWYYKIRRAQTSKGVRCAQQQPYSQRYYSARLTATERL

SEQ ID NO: 27167 - protein, 62 aa, Candida albicans
LQNNKYLQLAKIMSTNTDPKTNKPRKFVVVVPELFLETKESLSQLKAQRKEQQKLLQKQKLI

SEQ ID NO: 27168 - protein, 201 aa, Candida albicans
KYTLMCTVTSRLIMKKVHAGEIVGTIRSGEPKQVKGLGVPNNNRIRNGIIVQDSLQQNVSKQTMFDLNKYSRGNLFINFHVKLPRIENFLENDLVQLNHIFNNVPNSNDMNNDHGNIIESNLANLPGSRANPIVLEATPSVSESPSRESNGSIKLDFSNIGINDGTNTTGRDNSSHPYFEEAQNKRRRFESDLGCGIANPI

SEQ ID NO: 27169 - protein, 60 aa, Candida albicans
TEMTNNIQLAKLISLIHQAKCTVKEVNSTDSAVHNQFLKKKKWKLCELSKVRAVITLGLL

SEQ ID NO: 27170 - protein, 95 aa, Candida albicans
SQKTMTLIIGQRKNGNSKQDFLTITNVCNISDTFFFLHEYLLGQTSQKRYSSIRSMGICFYARSTLTTFVNSVIVLGGLNVTRFLMCQTMHHQPL

SEQ ID NO: 27171 - protein, 186 aa, Candida albicans
  UNSURE (33),(105): Identity of amino acid sequences at the above locations are unknown.
TKLSSEISLLVLKKTPAHTFHHHQKVKEVSKVXVKEDLIVVSEEEEVATIVMTEAASVEEEVVSIEDSIEVDLEEEEVVMIGVDLEAEEVDLTEADSEVEEVDSXGEEADMIKVDTIVITSTTEVDHTIVKDLQPVFNLHQLRIKYVWDVFPKGIKKKITVCCVYLLYSIIFLFGQAIILDFCFIC

SEQ ID NO: 27172 - protein, 80 aa, Candida albicans
FFFCFDFHLVVIIANCVFHFSFQRQDNQTRHKSDSDISTNMARRLTRRQAANPVSYRESSDSELSLHLGIRQVPRLFLIH

SEQ ID NO: 27173 - protein, 68 aa, Candida albicans
PSLVMCDISVLEWLITMQICDPRTTPSLISCVEFFFFSLLVEEEKFSSRRSLNLCLTNPLHHNLKHPL

SEQ ID NO: 27174 - protein, 90 aa, Candida albicans
TILNFHLNSVRQIPSTCEEQRKSPKLIELLLLWWCKTIQSVEGYGKFLPLITWNGLQLCEMSRGGERKKQKFILLSPLARMTIAYVISVN

SEQ ID NO: 27175 - protein, 67 aa, Candida albicans
LLLLLPILLLMLFVEPAENDSDEDDEDDDDDVDDEACGFEKYVFNELEDILLANSLSNECAEVALLI

SEQ ID NO: 27176 - protein, 62 aa, Candida albicans
GFPSLFILLVLFFGNQSLIYLWQLFEVYFYNLCQSYIWHEKISEVYCSFDIFVRLSSYLMYL

SEQ ID NO: 27177 - protein, 243 aa, Candida albicans
SYLSNSVESNNVKLEPTFYQSWSGKLQKSIAQVYSGFTNFIVLSSNSKKSQLKGNENSNPATRVSGVLNWSLFSLLNTVFNLQHRKPFFYNLIISIKSLLQMNNRIAGSIDRITGEFIKTKINQSITRDKVARIINDLRVYLFYLSLDDQDPVDIDKKEQVSIDILTDKIIKVYKAYLAKYLDLSYKEETEQDLKDSIKLVLIIFQQKEENESDLQQYLDNRVNKLLIIKLLDCVIGNLYTDI

SEQ ID NO: 27178 - protein, 73 aa, Candida albicans
VNTVLMKTGLYSFFFYFFVCGKRINPYDFLKSSHFLTFSYKDLMDLFFKRHDIIYFLLQKNKTKQTEQNPEIP

SEQ ID NO: 27179 - protein, 109 aa, Candida albicans
QPQFVQQKQQQQQQQKDGGLPYPTMSRTTLIYNNDDTITDEQIPKSTAQQQKQDQGKGQLGTSLYPGQVNGERPGQGISQLSNEEVSTLNSNVESNPRNAVKKNEHTGD

SEQ ID NO: 27180 - protein, 67 aa, Candida albicans
LPHNSIDRKVILADSLVDVFRFLILVQWSNITETCVELGVTKNKEGGLQGIVETNPMINFLYKYRSR

SEQ ID NO: 27181 - protein, 69 aa, Candida albicans
IQSTIIETKKKKDRILFSGCFNIFVCTKLRLSLLNKFMKTTNTSTQIVFGETITTHYNLVNKDAIRRQY

SEQ ID NO: 27182 - protein, 75 aa, Candida albicans
VLKLNLKNLNFPLHLVGLANYTIYIKPCESFAQAIKKEEDGKIIRQSAVGNRSQVRYKQNLIKLALPGDNRKKNR

SEQ ID NO: 27183 - protein, 90 aa, Candida albicans
IDMQAYFFFQLPHFNLNLEKKKHPSLVNHQEQEQEPPSSCQETRRKIGHYNYSNNNVDLFWNKFLETNKLGCVYFPKNFQIFWDFLNDIP

SEQ ID NO: 27184 - protein, 67 aa, Candida albicans
LTSLNLSENQEMQKNIDIEEIRTPASYDSRKPLFTQKKKRILESTALDQLGHNAYFVIEKILRVTRR

SEQ ID NO: 27185 - protein, 73 aa, Candida albicans
KRCISTNKLVYYYDDINYLIPTAHKLSCTNSSSRGSSSVRLLSSSNILFSQLVSHLPLSIYFFQIARKKKEKN

SEQ ID NO: 27186 - protein, 134 aa, Candida albicans
PKHIIIPDMLPIEKKTKVDKSPKANVSAPVPLKHVPHPVPKVASLDHLKQQIFEQDGPLRSLTPNTMGQVQRHMVRRPSFGTIVTTREQHYNLDYPEDPDELTKLQLDPTSRFYARSKPSTFDLPSLFDLPTGR

SEQ ID NO: 27187 - protein, 130 aa, Candida albicans
NCIFLRKLLLCSRKSRSMFQTKSLAVVVIKDHRMQIFRNEDFQDMFPICLHSVSLTGNSNDHDENFERSTYYCSTNRLAVTTRDIRVLKKKRFSNTRSVPGVVAGNATWQNTNTHTIATYLQITHYSKRD

SEQ ID NO: 27188 - protein, 66 aa, Candida albicans
IVVSMKYLSKLHDEIARLNKDNAGLRNNLKEQELKRVDAQQGRPQFANTTPANRVSSSPRGWKDPH

SEQ ID NO: 27189 - protein, 102 aa, Candida albicans
VKNPKKKKNYSNNNKTTKIKFEYPLIIRGLCVKFQTIPKKKGKTEKLIKNKSKGGRKVGHGQGLGLINHLLWSQDIFSHIRFTSLWISTHNVTSWVVGTNNV

SEQ ID NO: 27190 - protein, 67 aa, Candida albicans
IGKKMKGVLPHAILFFLYYGHQEFLEQNLDLYVYNLNTTIDDSNKSGQVRIIENEVNKHNILNLFPF

SEQ ID NO: 27191 - protein, 73 aa, Candida albicans
KRKEISKLKRQPLLPSVRNSKGNNNTNNYNNTINTIELKDLNKKGNKSQFNGTKTTSSSRNNFISPPSISSPS

SEQ ID NO: 27192 - protein, 80 aa, Candida albicans
FNNCVYKEKKILYMKNNQINYKGMTRVNLSKVDERKPINKILFYKTIDIDTIIYSEQEMGNIVFMIVHFFSFFLKLMVAS

SEQ ID NO: 27193 - protein, 80 aa, Candida albicans
QIWETQYQQYWNENLILAFLSFLLGAMALCNHYNINLVIISIVQKAWIFSSQFRQSALPQLTSFSNNQLYNNKTVYTQAC

SEQ ID NO: 27194 - protein, 76 aa, Candida albicans
KKLTSVYTISYYQIRLHWISICNRTNNSSCNQNPAVLLQSLLTIGIDKVPNIYLYGKYVVFLNTSRIVQILFLANK

SEQ ID NO: 27195 - protein, 62 aa, Candida albicans
ERFIVHGEPWQEKKYYSNSETPNSLLVGFLISCKRTRNKLELSIVKDGLTGESSVKVTNNQF

SEQ ID NO: 27196 - protein, 65 aa, Candida albicans
MFKIGLKKEGQEFIIMCKKSASFFKVYVGNGVDVVVLVLFKYLYKYIYIQERKSVIITSKYLNSN

SEQ ID NO: 27197 - protein, 102 aa, Candida albicans
  UNSURE (67): Identity of amino acid sequences at the above locations are unknown.
ELNGSFRQNKLVRKNMQMYKWLNNFLVVAKTETKVESEKKKERVTIANLPFFLLLLFFLSAATAATXKLFFQWSLVQERKNLKIEPCFHPLQIPFNWNWNWF

SEQ ID NO: 27198 - protein, 77 aa, Candida albicans
SPSKLQTHQSKEEDRTILAKLLFAKKNINSAKEKERKKKSDSLRYQSKFQHDSALSSICLYFSCLENSLCINSKSIN

SEQ ID NO: 27199 - protein, 73 aa, Candida albicans
FQNPSLYKYQGKLVIPFTYCYLIYNEKKQLKDNYQRLRVLSLFSNNQWYLDLLQYNVAEKSKKKIGDSKLIDN

SEQ ID NO: 27200 - protein, 61 aa, Candida albicans
LESSYSCNTFCKPQLTSGGEILCTPSFNPQLIPILLNLFLDEFQELLQIRGGISPWFNQVF

SEQ ID NO: 27201 - protein, 67 aa, Candida albicans
YSDMFDEIYGVFIVIATVIASIAISIAFAATVTFAISFLAGFTFIIFIAVAIATIMSTAIAIPILLF

SEQ ID NO: 27202 - protein, 63 aa, Candida albicans
KWVRNGNSNFRILIRHSTEIEMSDYFFLDSSYCVIRKKTLRHYSLGLEVVVEVVPVTSRFYRH

SEQ ID NO: 27203 - protein, 311 aa, Candida albicans
HHKPLPSPLLLILHLFVSFFIVSIHTLSPYSLILLILHYIKKFNMSADYHAKMQQMLFNRYTNPTPNVAQEANVPHIANQGPNAAIATTTTTVNSTMVPTMNNNYYPQPNGNHASEMSLLTPNIYEYKSNVIENQGGNDFGYFSSRAAVSVPSSRIDSYNSNNSNTFEEEIERFTKEHDSNVIPIHGFNHHQEQFDNHSTIDNLACHMAVPPQLQQLPMPTLPQQTTALPLPPQQQQPVPQQGMQFYDTNQEFLEPVARPQAYRQNTAPASSLSIQNLQQHQLQQQQQQAYYNHLQQRHTLKSFDIESLPT

SEQ ID NO: 27204 - protein, 104 aa, Candida albicans
IDISGLQTKKINTPISINKYLYVYQILSNIDCFIVFLISKCMLLSIAYLSHTNKEKQHSNLNNDTTFFPLFYYVIHKLVAFCVILIFTSTLLLLLLLLLLLLRS

SEQ ID NO: 27205 - protein, 102 aa, Candida albicans
KVLMLKLFLSFFLSFCTQLVISICIHYYFTSLILISREIFFLFQRIKSHISVILLTYLKNYDDFITNIIFLHYYQLLMSIDYVVMFSSLFSCQFLPSFSKWT

SEQ ID NO: 27206 - protein, 63 aa, Candida albicans
WNLVCLISIFLYVNLEDKREGNRKSKISTLGKHLRRPISPHPYSPHSSCLSLLFVLGNRIATI

SEQ ID NO: 27207 - protein, 70 aa, Candida albicans
PCSLIYFKLVKSVSPSLVPSQIALAPQVQLDLFLFPQAQASFDDGTTFSTEALEQLHFKAGCLPHEQVDF

SEQ ID NO: 27208 - protein, 70 aa, Candida albicans
LSSYSPQAKYYGNTFSINNKSLILIHSCIQFKRNLLRETTGTRTLSIHFTNFQYFYALNYKYIYKTFTDF

SEQ ID NO: 27209 - protein, 62 aa, Candida albicans
SKEKYLKNLHLPLSSSPYINKNFSVMHISVLDVNYYISHYNNKVHKTDISDNLIYHHKYNKV

SEQ ID NO: 27210 - protein, 657 aa, Candida albicans
VEVESFPVLCTIFEWRTAYEKRHTLLKKINAHTPTRKKEKPQQIRKQQQHHHININQLSAASNMKRYSIAPTSSRRKSAIDATLPESNLPARQILEQLDQDTTFVLQEIDKNISRANTVINDKIKPMIQEYAFQSWKVWENTGFWTHFFEQSANVELGSYVEPINEVNPQNNFLLLNEIEKNKQKGRYEDSRGSNKVNQANNDENNDIDNDEKEEPEIAFKKPNLRRLVADGNTPTWSTEHTKPSMKSIQLSPPKRMQTTNFTGGLARENTKLTDSITLEPPALSAETRAVTSLPHSRHYQNQHQRLQSRDSPIKIHTIRQSLDTYHRVSISPKKLKTPIRSTRTSIIESILNSSPILPEPPVLQSEIGSETPKYMSSSSPMKKQQPQQRESLNFQSDNDQQQGLQRFPNTPTYSRLSGSSVNSLLSNKSNLSDDEDDHINPPPQLDSDNHGVVIDNSDTNNNNGDSSDDLAALPVPELNTIDFKDKNSNNNNKRSIQSTPRSSEKKRRSINTKNTNNNNTSAAATAVVVDDDDDRENVFLDHSYKKTPDNQQSNNSTRFFSTGGSNNDNHTETQDNSKSFSQIYDEAISKIRGKKTTSQSNDQNGDEDGDVVMSLDMTVTKDLTGEPTKDLSKDLTENSTTDLGPFRERWKKLTRK

SEQ ID NO: 27211 - protein, 70 aa, Candida albicans
NFRKKLNSNNSATIIIEFISRSTLTDSIVVYSAGLSHASRKIYMYAQQQKGAYKVVKSKTRKWQSLLFCI

SEQ ID NO: 27212 - protein, 68 aa, Candida albicans
PPKLIEDSTAVGGAMIDNYLNKLMIDSKKERKKSIKFSREFDGGFILIYQTINKDLYQRILLENFFSF

SEQ ID NO: 27213 - protein, 75 aa, Candida albicans
NCYLVHCRQATKNNNGGPGRCSVPRKEGITDVFVTTKPSSKSMSSNQHRRENQIHTCLVALGELEFSVFILIVKC

SEQ ID NO: 27214 - protein, 61 aa, Candida albicans
LLGVGHVIENFRLHTERGKFSFVLGSSQLMENNNHYNSATLREVYQYSLFIRSTCEKEGRH

SEQ ID NO: 27215 - protein, 79 aa, Candida albicans
IAQSLSTQNYAKTTNHKKKKKKLSTAVIESRPSAHYPNELVSIFQNYWLTNNTVNSSPNLFLPTPLAPQGTIECFFLLS

SEQ ID NO: 27216 - protein, 86 aa, Candida albicans
WRTITITTPQHSEKYTSIRYSYGVHVKKKGGTKIMNISIVQHKRNVRVLVQKKAPNLLTIRNTFSILRGYCNDTLTITLNSKTIAM

SEQ ID NO: 27217 - protein, 279 aa, Candida albicans
NQHQYSKTVHCCGANTHPQLSQSDPTIYILRHLIGFEFVINAKSNYDVKQKQNILGRNTRKKKFHFTFSTKMRAYNHPILVNPTRWLRGPKKHAAALYHNGYYPSLDNNPFALALARLDANSPSSTLPIGNGIPLTVTQQDNHHVLTPTLNDTAEPSRLIVNSARYIKLIVDRPKAIQKLVPLQFIQQCKSSKAKVSMNRDMVDVIDKMYRQRIEELLEDVGNESGESGIILKPMDVPVRIEGSTTYVNNIFTTHPKFINYTHRELSQLILAYTDFVNL

SEQ ID NO: 27218 - protein, 65 aa, Candida albicans
CNRKMSPSDITTIKKPLEYKTKKKVQMPNKQKKKFLLKRASGRGGLVGEQLKFVGGVYKTLKATR

SEQ ID NO: 27219 - protein, 109 aa, Candida albicans
MCIAKKKKFCCVTLLPIMTQATLQTIYDRPYEIFKTDGEFFNKLVKSFIDPLAKKYSVLDEIYIDGLDSSQVFGRTKMVLEGVGEELLGSVIPEIQGMVRDGAEVFTTE

SEQ ID NO: 27220 - protein, 63 aa, Candida albicans
CGVLAEHFGCGVNRMLKKKKKKKGDEIYWIEVAARHSRFCVKRGGSGKSLGHVCLYLNTERQR

SEQ ID NO: 27221 - protein, 93 aa, Candida albicans
SFAIGTCIGTLLNCSSTDPLVKESYNDGLYVLVGSVGLTNKLRAAASEIFSCFRFFDRIVLVQKNLVADFNEDDVISSLGGLTFNIELVNFDF

SEQ ID NO: 27222 - protein, 61 aa, Candida albicans
FVDYDSNHYCFIRSRKETKQSNNAKQNQENEKYKTVFLSTLSYVVIIYIWFSLLLFFFYIQ

SEQ ID NO: 27223 - protein, 102 aa, Candida albicans
NVIKIYLSDSEQRKKKEKKFVELFMALVHARAQLKFLFLYCLQISQQNSVTEEEEELFLIQRRQLLNIFFFLQYTLIFEWDFLTHEQKQQQQQQIRRPPPQQ

SEQ ID NO: 27224 - protein, 63 aa, Candida albicans
IFYFITRKRLEFVHTEYDMFHSIITTLKKFSLALCYYYLMISSVFFLIINIGLAICCCMVRVS

SEQ ID NO: 27225 - protein, 70 aa, Candida albicans
KKRLTKINDFITLKSQSIYELSITTLKIRKEKDSILQQQQQIILLLRRRSPNLLLLLLLLFVCEEIPFED

SEQ ID NO: 27226 - protein, 75 aa, Candida albicans
SVRCPNNQLTGVTVFFYSPSSYFFFNETRHNGGEFKPIDKPKGTSFPSTPISFLSRPSPFSPLIYLTTQNFLQPS

SEQ ID NO: 27227 - protein, 64 aa, Candida albicans
NIQNYVFSELYWSMFGELVRKYLVIGLFIVYYNVIAPHLWPLILSCRLNLIWKYQDQFFLNERQ

SEQ ID NO: 27228 - protein, 69 aa, Candida albicans
ITIKSDSASRIKVTVTHRLIILYIQEKKVKKKSKNSIINCILISIEPRIYKIKFIPCHFCLYKAGGISL

SEQ ID NO: 27229 - protein, 68 aa, Candida albicans
FTLCGTKYIREDPLQTGLQEVLHENDLLHDVELKSSTSLSAILFYLFNFLYKIKQYERASKSIMSTQY

SEQ ID NO: 27230 - protein, 104 aa, Candida albicans
KKNNIKLFLIDCCYLFFISEFLHNGSTTANTDHTLNFFFVQDPVVVAVAVIVIIVVSALMMTKNDRVQYEEEIKRYRFMMCLVINCSQWFSTTYTKLVVLETNE

SEQ ID NO: 27231 - protein, 62 aa, Candida albicans
TDAGLDQSVVVVEVPKNCITTASEVFCSFFLNCRDKANLENHSLIRSVLLIRFKHHQFCIRC

SEQ ID NO: 27232 - protein, 91 aa, Candida albicans
  UNSURE (14),(15),(16),(17): Identity of amino acid sequences at the above locations are unknown.
DIYIDIHCTSFIKXXXXGGLFFAGYCFKCSISVLSTLGLMKIAIVKIFWLLMMHVCVSLSLQLGVMPSIFLEPFNKSLIEKGVADKYFETL

SEQ ID NO: 27233 - protein, 74 aa, Candida albicans
  UNSURE (9): Identity of amino acid sequences at the above locations are unknown.
IQKTQHKRXKEHKFHTFSLSIGVCRVFFFSYSKSSKSELLILLLDVVDIDDLTLALTDDDDFGDNTMFVLNPGG

SEQ ID NO: 27234 - protein, 103 aa, Candida albicans
RRQFGRGKHGGQASQEMAAAGGFDNGRNGGGYRGRGRGGFRGGFRGGHRGRGGGFRGGFRGGRGGGGGGGGFGRGESSVYIPSKDPTFDAPTTFNPLADMSQN

SEQ ID NO: 27235 - protein, 64 aa, Candida albicans
DIILQRRNIWSYNSTRQSKLNEIAKLNTVIKYSSYLNVLRTITSRGFRPSRPISKYNHLPDLTK

SEQ ID NO: 27236 - protein, 77 aa, Candida albicans
  UNSURE (36): Identity of amino acid sequences at the above locations are unknown.
LLARKIMLWQTWKELFVIEDGEIIALVDEDSEPVVXRTLDDLLLRPIEQNYHGIPMTTCSQTTSMCWIHLWCKVNCF

SEQ ID NO: 27237 - protein, 84 aa, Candida albicans
RYVQIPLLLYPVLVKLEVLGFITSTKKSPIESMSNVYLYNQQLIRLVGLSPLHVHSYNNKHHSITLLNLFTVSRNTQMQNLANL

SEQ ID NO: 27238 - protein, 103 aa, Candida albicans
NKQKAEEAKKAETAPQKFDNFDDFIGFDINDNTNDEDMLSNMDYEDLKLDDKLPATTDNNLDMNNILENDELILDGLNMTLLDNGDHVNEEFDVDSFLNQFGN

SEQ ID NO: 27239 - protein, 79 aa, Candida albicans
KICTHREPGISIKRREKKGIYDIETEFQSTLLVGVNFIYSVFCLLKINAYRVPGLILTNIPCIQTVPFSLFYDTYLQRP

SEQ ID NO: 27240 - protein, 64 aa, Candida albicans
LGWPYNGYTHPLNVVSAAFHEICHNFGVAASSPNRTGHEVTTSYNYAMGRPLPQRDECNVIPPY

SEQ ID NO: 27241 - protein, 100 aa, Candida albicans
ENAKTRRKFCFERPNYQLTDKFISYSAILRVNRSKKSDKSTYTLVHHPQTPLFTDLKSILGYKLNVKRPVFYILVRHAPPTTTTEKIFLCHWTKEQERKS

SEQ ID NO: 27242 - protein, 61 aa, Candida albicans
EKNSVKGLVQQILLDSNYIQEIHRNKALTTTPFFYLHMYFINTYLRSINIKPAVGLNRMWV

SEQ ID NO: 27243 - protein, 74 aa, Candida albicans
GMTVRPTIAQLKNNAIDSLNISLLTGKNPLNIFQPDPGSKLHLKSSKIKQTHVAATNIDTNISKNLVCFMLPSL

SEQ ID NO: 27244 - protein, 505 aa, Candida albicans
SSSFNVSSNLTGKMILINPMISKCLINRNVASRHWFKLLATRSITTSTTNFTNNSLVYNLNNYKSSFPEDFTVNEDISKYINLNKHKLETQLLKIGIIYANKETKTNSKLIEALMADPLASGNEIWFDKIANRKSFGKFVYNDAPEVDEESGEFGIPSPILSGNYRNKFQQQIEIANDLIIEEVSDVTNTGDYIFLINVSNELKNTDYHKDVKNKILLNVLDNCEFTPYSSESTPVTFATSSHSHLIKINSQLAYKGITEFISKDVMATDTFINSMTDSNIYELYKAINWFTQTLVLEEWLLHNIKSQIKEQISTAAAPEEINDISNMEIARFTDLVNTELQDEFKPKTTKFFHKNLIWWKLYYKNDNVEYDIKDFFMNHFMNKSIENYNYLKGKISLVDAEVIDNPLLKLKNKVINKRIAEEIQPFVYRALATAFLYYQLPISLISFCGYQYFGYGANECIALTTLGLVLGFNQVSKIWTNFTEKWLNGLFEEIRICLGKECIE

SEQ ID NO: 27245 - protein, 62 aa, Candida albicans
NRCKLVTTNALIVRNWDGPINEAQFRKYFLLQYLFLEIFADLASRRVKNRNVCIPIKLATRL

SEQ ID NO: 27246 - protein, 150 aa, Candida albicans
EIKLGKYYQLFHTNIDNISMQSLKLVIETNKIRPAKLKEFDLIFTNMDFYVEVPFIPNSLTYKNMPVLVAKDGTQYEYKETKQDVDETEASVIISSSPRINSDKWILSDTDIGDVNDTLPTTQLDLILTSQSIFDSEGFTNVKENENVNI

SEQ ID NO: 27247 - protein, 76 aa, Candida albicans
DFSFFCFFLSFFWLEQQMSQIIQTTFVVHVTLLLSREVSQIYVFSLHFYGHQLFIHSLFSKICDLMILIKRKQREY

SEQ ID NO: 27248 - protein, 63 aa, Candida albicans
QSPTTVKELPDRPSNAFTNYHHDKLEWESHVMMVIKNALEPWESKKCKQFSAMEKVELIEAVL

SEQ ID NO: 27249 - protein, 80 aa, Candida albicans
KIYAKRPVSQFICGQLFFLLPLSLSVSPSHSFTYFSFSLQTHSQSNFSFFSRKANFTQLSKLTINNNEIHNNNNNNNNNN

SEQ ID NO: 27250 - protein, 65 aa, Candida albicans
NCDEVSVTHLIIMKLLLHNNNLKRHNRLCKIKKNRRDINIISYGEVCNYRGQLKIRIVQFDKVIT

SEQ ID NO: 27251 - protein, 91 aa, Candida albicans
LENISRYNDNYWCGWETRTHAPHKAPTHTLYSLICPQTLIILSKFHSGIANLAFPNFKFYCLIIKNNIVKLIQQPILGVHNAENLRSYILL

SEQ ID NO: 27252 - protein, 81 aa, Candida albicans
KEERWELHQEDRCCKYKRIYHSRNIISRSGNSDNNTMQSRLLSPATCLDVLWVKIVYFCLIKKAPKWRNLDVTVYVIKEKP

SEQ ID NO: 27253 - protein, 136 aa, Candida albicans
NLWHRLKCTMSNLGTILLSGNIIGTLTDRSTNQCKAQNSSNKENFNYYQDQHDKLKAKKLFLIQYQKKLQNEIRCLEGKRAELQVFVNNYESSNFGNQDSLKEITNSGYNLSCQPTPSANSLGVEMSSSSDTFISQ

SEQ ID NO: 27254 - protein, 112 aa, Candida albicans
LQITEVKTTEEEIIEEDVAIKEEKEKDGLYQLMLLLVRKEMNLELVSLRRRNLEQLIMHQEDKGNYGDQDNSTKPILFYYNIKFLFFFGGGEGPFGYLYLLPFLFEQKKICG

SEQ ID NO: 27255 - protein, 67 aa, Candida albicans
LIPLNKFQFIRLVAKIKIKLNICLHKKKIKLNAEQSRKEMGRNCGVPQSYLPIDANYISSTLYSCKL

SEQ ID NO: 27256 - protein, 61 aa, Candida albicans
  UNSURE (4),(5),(6),(7),(13): Identity of amino acid sequences at the above locations are unknown.
SFFXXXXSLSLSXSLSLSFIVCSFVQSRANLLFAWWLSDEYYVLGRVFGSTIYFHTLQTII

SEQ ID NO: 27257 - protein, 69 aa, Candida albicans
IVLLEFGGILMNKVCAWVLCGGRACGFPTRTNNYHYNERYFLIRANYPVYKRMQYNTDSEIGDSLFNGQ

SEQ ID NO: 27258 - protein, 144 aa, Candida albicans
TPTHTYIYTSMESNNNKLKKKSIIIAYNEEDEDLEEEEFKIKSVYDLNKQESNDIDNNTNEIKQLDNTNIEHKEKKEEKEKEEEEEVLELKLEEEEEEELEEQVLFPKIINRDPSIDSDYDSDLDLNNSESISINQLKAHKYLG

SEQ ID NO: 27259 - protein, 87 aa, Candida albicans
SFINFNSVDNDNGINDDLILESNNVLFILLVKFIDEQFTVIGGADAMGVTAGSNLFKYISSPTFSLIETRSENTNEFEIKLLLVLVL

SEQ ID NO: 27260 - protein, 73 aa, Candida albicans
ILSLVFTTYQSINQPTTHPPTHHDLINAPTFETLLLLTQPFLVNNSLHSINSKQTKTSWFCPIQVQFSTYKLD

SEQ ID NO: 27261 - protein, 68 aa, Candida albicans
NGICWKMWIILNINGKQDVFTELFNEELEQFSKLNLKIIPNSNKFSWIMELMKISSKLLVNLNLILNN

SEQ ID NO: 27262 - protein, 60 aa, Candida albicans
VMPKIDANLNLIKNEPNQAVFVKGHDVRVVKELPCYIPDFSQESSLLGNGLCLRRFESCS

SEQ ID NO: 27263 - protein, 70 aa, Candida albicans
DRCRRERLRNLWKIEKRDVDLRVGAIICDSVKSEEKSIGYRVICGESNIHIGGGGGYGMFQRRERGNVES

SEQ ID NO: 27264 - protein, 83 aa, Candida albicans
TTLTWMLFLTRTLLTHHAELAIHMVTVVIKAINLFHLKNYIFVCNSNMLKMPRKTSQTIKLTEAVANFVDARAFYVTCNQLFP

SEQ ID NO: 27265 - protein, 69 aa, Candida albicans
IKLVIIFTYIIRFRRDMVERKMLLLLSAYCVDSIDRRKTGLTVLDFGEIIVSPHFIHKLGQLQSNLETI

SEQ ID NO: 27266 - protein, 133 aa, Candida albicans
IDRMDILLTAPLPNTPIAKFQNSSVMCHPSFKLLCSYQLNLQNTVEFAERESQKKQWLHVGRVRSANQCWFFFFGTQIFLFTAKKKFIVAKTIAEKAVTANIIPQSRIYSKKKYLNIYLNKSLYNSTKSLYSN

SEQ ID NO: 27267 - protein, 68 aa, Candida albicans
DNYRLQYLVLNSRFLNNYKTNSFPFYFINSQEVLSFKKLQVSNVRKKRIEKPDRYRTDNIVHQRRYRR

SEQ ID NO: 27268 - protein, 92 aa, Candida albicans
FINPNYVLRMLCQVGLNVKVPFHFLFYSLTFGGSAFYSFIVSPLVFKKLPREEFSNLQNKVFPPYFTGSNIGSNYFRFGSTICLSSNLPLDY

SEQ ID NO: 27269 - protein, 68 aa, Candida albicans
LKPSHVKLDLMSLLVKMLQLAMGSEWSIALFVMMLQLVTTQSSKMQLLPMELKLENGAESKVRSQLVF

SEQ ID NO: 27270 - protein, 360 aa, Candida albicans
TRIILFPVHNIETFPSHDGYIFLEINLNQMLRSVSRDSFTTLIDQDDDDENDDLQLQQHENTQELTSDLISLISQETLINTSIQIMNRNISQFYKHYELPLILSYLHTGVSLYLSLQDLLDNKPPILTRTLSMMNFNNLLRRPFRNSSFLTIHKHDYMNNKFEFCHVDFKIHSNHITYYILKFPTLDKTVYLINNNSSKPTVDFEYKKTCFRITGVTGTTSVIGVSPEIKLYVMNPNSKNLLTYNTTVSNGKKLQINNSLSKLVNSQDQPRINEMLKNEKPVISIPMGRYLDQGDVKLKLDSNSATKSKLNIIKHGVIRLFDYQDEVGDTGNNVVSDDMLVLCCVLLVLREQEYRKFKSG

SEQ ID NO: 27271 - protein, 66 aa, Candida albicans
SEIFKKEGTTNTERNQLKNLCDKNEGKKLSSSRAIVPVLLNYEVSQLCNSRETIVIVLSLFGTSND

SEQ ID NO: 27272 - protein, 94 aa, Candida albicans
FPYKTEIATKKVIPQTFTAQKHFRSSVSYNKGGGEMQVICTPTHPPPPQYHFVQVYQSVSKYTNIIYCNYLKSIWGTRCLLSFQLATVIHFATP

SEQ ID NO: 27273 - protein, 65 aa, Candida albicans
HNHIELYNPMYKVVGIVVHVMKFTAPECPGNNFIVELAVRQMLATLLFFEFIENDQDCHFFHPMP

SEQ ID NO: 27274 - protein, 78 aa, Candida albicans
YRNICNVVNVCSISVVVMHVMDEMSSMVISLEKIGDELSPSLDAAALANIDDWEAFEPGPGVGVAELSLPFSASSYSN

SEQ ID NO: 27275 - protein, 69 aa, Candida albicans
SEKKGILSKLKLSFYFQKLVYNNRNLQKCIKNTFNAKKKYKEIQKSFPLNSSCSSSSFSSFCIEKEILI

SEQ ID NO: 27276 - protein, 82 aa, Candida albicans
VSNWSLVSYIVCANLVDQMKACLDLLQLITMQKKFLVKLPSIFTLFICLSSLLQNMHQVLLKIISYTSHLQYRLFFWIYGHV

SEQ ID NO: 27277 - protein, 224 aa, Candida albicans
FEVYVTMVNLFNNSNNAFDALFNNVGTFAQNSCQGNNRNSNRNDIQVKELNKSNQHEIQVFNRSGYQNFKIEVVRQGGQLYLQIQSKVDRFERYFKLNTATEDINNVKSYIENDWLIVAVPFINRGTRSPQPKNVPEHPSKKQDKKQDKEQKQQKQQKQQTQQTQQEQQKQQKQQKQQKPQKESKYARVKKIFGKKKNDSNHPVSLLEAARRKPFLEEVPDPGI

SEQ ID NO: 27278 - protein, 65 aa, Candida albicans
FAILVYELKWVCRDIIFLCVYIYKFKLINILDLAVTNQRKRLFFPITVRAPLPPPLPSDSLEAIN

SEQ ID NO: 27279 - protein, 60 aa, Candida albicans; identical to SEQ ID NO: 21998

SEQ ID NO: 27280 - protein, 74 aa, Candida albicans
KKRKLVFGDDKLWLIYRNPKEAKKKKIEECKSSDSNFPQHPQYKMYHVHQLVLRLCRYCIRLASKLQREGNIEH

SEQ ID NO: 27281 - protein, 239 aa, Candida albicans
MYGRSRGYGGYRSGYGSSPYEYGSSSSYGRTGSSSNKYNKQTYPKSLQQQQQQGAPTYKQTSYKPQYAKQTYSQTPSSQQYAQADRGKSKNYKPTTPSNQYKKKTVNKTVNVNQQPRRSRRGLGGFRSMWHIPMIFMFWRGFSRNRHQPQPQPQPQPQQNEPINITNMNYPSSPENTTAPVQHSQPGTNNTEESLPRSSQIIKPEQDETQSVSSYHSAEEEKKVDSYDNNKVPQVPTQD

SEQ ID NO: 27282 - protein, 66 aa, Candida albicans
FWFDKGGESHDRIIKNGKLLNYINGKEEGNSCSASDGKEQVYIYYFCSIPFIIFVFMKHTKIILIT

SEQ ID NO: 27283 - protein, 65 aa, Candida albicans
VSYNSVKIQVLLKKTRNQLKIDFLISKNRQLSLLYLPIFPKNFFKTWGSSLLSVASLYFLMAPFS

SEQ ID NO: 27284 - protein, 79 aa, Candida albicans
AFVECVTKFILRQYFAARVAKVCSAKREKVYSANRVQLFTNLLDFKSFLEARFLNGNVNLIIIKSKPWWSCITCQYPQF

SEQ ID NO: 27285 - protein, 63 aa, Candida albicans
FSYSFVHTDTFITNNYQKLRSKHLQPQPLAHSLLSVVHHSLAHAVCIICSHTVHKVKFLVTAN

SEQ ID NO: 27286 - protein, 70 aa, Candida albicans
KKELPGKRFTMPSTSSKRESCEIQYAYTDDGVRYIAVRYKSGKTDILTQAEYRRLYPIQRQGTKKKHDGT

SEQ ID NO: 27287 - protein, 92 aa, Candida albicans
ETNHALSISGTFIFANQNILQGLVNIQSYITTIMSAISGLFNGNSFVVIGCGTKEGEKYVTIRLENGQIKTVKESEVTYDEVTQLSDFLQNI

SEQ ID NO: 27288 - protein, 73 aa, Candida albicans
ETSTKHIIFEKNPLMSKNTPRGKIVDVVSYHVRNDIGYVSVRYENGAIKKYKEATLNRLDPQVLKKFFGKIGK

SEQ ID NO: 27289 - protein, 63 aa, Candida albicans
ILNTNCLMPRSSSKGNIDSIRSNYTENGIDYVVVRYESGETEHMKLIDLLLFPHNKIAKVLKK

SEQ ID NO: 27290 - protein, 71 aa, Candida albicans
YKFCDTFHKSLYVNKNPLHLILQYKSSPVYLKIIFNNCLLVCLNVNSKYTTTLNNQYSNFYLNYYNVKWYL

SEQ ID NO: 27291 - protein, 68 aa, Candida albicans
FPKVSLTDFFVANQIQIQIEMPHLRGTFEGRRFAVVAREHRKTGIYVLICFSDGTSTTVPESALVYEK

SEQ ID NO: 27292 - protein, 84 aa, Candida albicans
TKSNSNSTFSLPPLLPSSNRGRNTIIMSRGAFEGKKFLVIDRQRVKRLWYITVQFETGEIDILDEKDVEYDEDAPLKAKSKAKK

SEQ ID NO: 27293 - protein, 63 aa, Candida albicans
KKPLAIMNLNQNLQSNSRMSSTSNIPLLNTVGSPDNNNNTNNNNKFINCSYSHNLATDITWYL

SEQ ID NO: 27294 - protein, 139 aa, Candida albicans
HGIYDYVIPPIINTTTTTTKTTTTTTERQQCLIIEIGNIKLYGIFTNQIDDNVKQIVMIFNKELLLYINTENIKFNRLMVDFVDLLIDEFDITDMLCLIERLEESSTLARKFNQLFPCSLVHVDKYVDEFHWLGLLCKI

SEQ ID NO: 27295 - protein, 63 aa, Candida albicans
RSSNKSFCCSSKFFNKFASDNDCDAANDNNDELVEVPDVVGGIGVDDDVESLVESACGADPKC

SEQ ID NO: 27296 - protein, 113 aa, Candida albicans
HISPGLDRKFRIVTRIPGSPLLISLSLSNTHTPNNNNRWQEILTNKYNNYLGYFIYLFFFLLILIDGLSETRIINNSKDINPLLLLIHPSTRGGDIILISFLRLNQPKNDTTV

SEQ ID NO: 27297 - protein, 64 aa, Candida albicans
LLYLLVKISCQRLLLLGVCVLDKESEIKRGEPGILVTILNFLSSPGEMCQKLSTCGKKRRMKSG

SEQ ID NO: 27298 - protein, 70 aa, Candida albicans
RHVPAWCYCTRLQENLRIPIYLPCAKKKRREIMDKLTPGSIFPSSLVDFFRSQKLVRKLKHESKLANLLG

SEQ ID NO: 27299 - protein, 62 aa, Candida albicans
NYTGNYIQKHQTTTSCRYNNKRKTKSLAIYIQKYKKKKRINILHQILNNLPILSFFFYPPQY

SEQ ID NO: 27300 - protein, 72 aa, Candida albicans
FIQFAPTYAFWKVPFQQRGLFIKLKNPFSQEQNIDSIVSNINICKLHILYNLCFLYCSEATSFKVSNTTSLA

SEQ ID NO: 27301 - protein, 69 aa, Candida albicans
VIFPESGLVSVFFLIYYVGVRVGHRFPKKEITRENKRRGESQQQYKLDYILYKKHFLHEFSMLASCLLY

SEQ ID NO: 27302 - protein, 61 aa, Candida albicans
NRFTELVNTFLPKFYQLSDLIVLETSIKNKQNHPFINVYEYRILLIQKKNTTCLVDFQVAK

SEQ ID NO: 27303 - protein, 75 aa, Candida albicans
MLKWQTCKPFEKQIEIVSSVFFSRGHNPTKKRNLRGERRRLEFVPQSEQEINNILGLAEMRMKKQISSETPLLAK

SEQ ID NO: 27304 - protein, 69 aa, Candida albicans
NDIMSSVSLENFNLNLQISQYQVNTAINLVIAFGDTKKCDLIYQNPSVQLSAVIYWFVTIYKRGILRIV

SEQ ID NO: 27305 - protein, 60 aa, Candida albicans
LGDTSLMRHRIRNCIKLYGLWNVCRVSFVLQKIWKDNPDGSKVVDWHNLLKELGWDINFA

SEQ ID NO: 27306 - protein, 61 aa, Candida albicans
SNSGVSTHHFLLICLAPPPSLHTNFYSTSPQLVQKIQLSSNIILLWKAILCEMNQNDIYNW

SEQ ID NO: 27307 - protein, 85 aa, Candida albicans
GDTLEPLPCIKLSESRGTNNPTKVNDPRKRTITLKYTNLEAALIAVLGCLVSLADKLMNSDPPKLKAPETNTEAKPLKEVKAPGL

SEQ ID NO: 27308 - protein, 77 aa, Candida albicans
ANQNGVHFNLNWQISEIVHTKPLRTTSSRHRYKNGINFCGTIWLKRQGQKKAEWNCRWRERRLGYVAYLIIKVGEPH

SEQ ID NO: 27309 - protein, 76 aa, Candida albicans
LTLNIYQIFSFLVIGCEENTVRIINMMPVCSLTCIMLLKFDQKCINVQQKYKHKKYKTQLILRLLLLFLWSFFSII

SEQ ID NO: 27310 - protein, 120 aa, Candida albicans
HREYNTKFKLLAKIILFQLNDIYILEVFCFFKITRQEFITGKLISHERVKYLKIFKISGENRKKKRKQSKKTKNLNFYYLDLKKTKSESRETLNDAFFDAKSSCYLIAESLTNDSETNCS

SEQ ID NO: 27311 - protein, 183 aa, Candida albicans
LYYTSLQEYPVLIANIKFTSMPIQPLQSSTKMTLLVNNTALTYLILNSNIKLTQNHIYKILGLCSENAFHIEIFKLLIQLINSAANSIFCSIRAHSLSQYPLTNIQYISYMIADEFPEIFYVPIAKKVEFEINNGVSVLVDKWSTETVTLTVNRSKYNEMWIITYLLKTEFEKIIQQKKKKFK

SEQ ID NO: 27312 - protein, 61 aa, Candida albicans
ITSMLHSDKKQIEKTTQYTKPNFNLCESILAKTVNNQQLFIKHEIHTKVNNKEPNNKLKKI

SEQ ID NO: 27313 - protein, 130 aa, Candida albicans
IFFLFCSTIQKHIASITPSLTKDINKEMIPRSLVIGPILRYQVLLVTRMISTRSSLGAKYSFKKDLRSSNRNYIIEEPKQYQNPKVLHIYNEVATYLSGDTDRMRINIKSKVKQRKLFLLLSLDGGQGKK

SEQ ID NO: 27314 - protein, 468 aa, Candida albicans
LRKFPQNLNRDLVCEKVIQALMTSNISPTAPILDRIISELGVEQSVYSYKYRIDKAISKNDHELALKLYNESISNVTQWPEYTHDPSVVLTLNNLIQCLVNNLSMKEAFPLFQNVKSQLQKEINIDTINAIVPKILQEDMTGDIIELMNRELPKIPKDLPVKLPIEQPFGYKYYQLFDTIHEYCITNTKDKRMVNNWYLYTHCYNYFFIPHDRILPTMKFFCENERWNGALRIFKKVIEMSQLHGEHNHKPPTREMYLYLINEFGDKLYEDGVIEVHELLKMDLNLPKQDKELLHSIMSAYCNLQDVGKVRDIFLSMSLEPKDAGGVDETSATIMIKAYTYNDLIYVQKFWDNLSMFGLVPDYQMFKQYLIAYSYHGYIEKSIEIVNSIQDYELELTSDLLISMHNFCYQIEGQEKLKSWAQLNHPAIWQQAVESGKLIDASGYKPNENFLVDGSSSDPKHISEPIFK

SEQ ID NO: 27315 - protein, 170 aa, Candida albicans
FCSLFLFVLFAHFCNQHIQVMQVINDTSLLSEKYLTVVSYDDMTSPNYMAKLSKLSNSLHKQGLDLHKVCLIMRFKIKLKTSLQIAGVNYQVYSTISKLNGLILLLYEGLDLDCESSIDIKFNDFGDFGDSIKRCISIENFDFFMENEFLVSLENDSDPDTRLVYDNFIV

SEQ ID NO: 27316 - protein, 67 aa, Candida albicans
ENKLNVKNLNIFSFLFHYTKTHSINNSFAYKRHQQRNDTEIISDWTHTTISGPPGYKNDKYKIEPWC

SEQ ID NO: 27317 - protein, 134 aa, Candida albicans
KLKMHFSKIIAGSALSSVALAEFQNGTVTTHVTATGYTTYCPYPTTITLTICEEENICTKRPIVVSEPTTVTVTEPCIISTSYETTEVVVTTTLPSSLSPSSVAPANVTSFEGAASKNVAGALVGVVAIAAAMM

SEQ ID NO: 27318 - protein, 164 aa, Candida albicans
TTYFLLLLSFSSSFFINIHIIYFKAKYIYIIFCQNSWIMSYHSDDHSHNHSHSVNNEQTETIYNPKAKFPKTSRFFNNSSLPDLKTFEVIRQNKKILFNGQLTNFNYSPFNLPQQKLKASIPLDYRNLPSKILTLPASDSVSFEKRSPMFLFNTRADKRPHSIH

SEQ ID NO: 27319 - protein, 100 aa, Candida albicans
HRNNNKHQQIVDTKDQKPKRNITERISKELNKLKFKDIKTSSGRYNLAYIMAAAIATTPTKAPATFLEAAPSNDVTLAGATLDGERLLGKVVVTTTSVVS

SEQ ID NO: 27320 - protein, 101 aa, Candida albicans
KKEIGCSEIVLSMCFEYNFFFSYISCVGVRVERYPDISTLSSYIYLFCFTFMTQGYTSHSVKLVNPSLLISSFKVLETKYPTKITQLKNQNHFRHISKLIY

SEQ ID NO: 27321 - protein, 121 aa, Candida albicans
MIFFEGSHNTRTREKKMKRLIRVKKIFNLEVTKPFQYKPHSISIKSFLDIINMANNQLPFHVRATDAVHRLTVLGLVGICVVGGGSIAFNIWANSDYAPWNKEKLKFQQEQYHNTKKDEEE

SEQ ID NO: 27322 - protein, 124 aa, Candida albicans
WVDYWLSNFNIKILVCYLQPTTNKLLVVFCVYIYAGVCLSKSYLRVYVFVCVCKSKQVTFHSSSINVLRHVFFCPVRGFFKFITDGKKEEEVRRKENQNNTYEILTLIPPTRSYSPFNIRGTNL

SEQ ID NO: 27323 - protein, 64 aa, Candida albicans
QQQQHWFALCSNYDFNLLKLSEEESEAVKEALTVSSDTTCDTMVDLLGELAEKFNKCNAGDSPR

SEQ ID NO: 27324 - protein, 120 aa, Candida albicans
LELVIDGVLSRGENSNISGSIVSYVGVLINGSGIGAANDDGEDVTIDSAVDGGSCTRKSISATLCGSLFRTETKPTENTTTIQAYKIMVFTKLSWLITPSSIDVSGVGNVNGVAILLLSI

SEQ ID NO: 27325 - protein, 73 aa, Candida albicans
HNSLFSLSLYCLNLYQPFCFDYPHHSVAFFFSSHLNQPTIIPTTTTIHKPSTDFVMSQSPSSLSPATASSLGC

SEQ ID NO: 27326 - protein, 296 aa, Candida albicans
SDPSALSATSSTTPSQPTNVANHAPQNSDIDRLIASINNTTTQGYHTIQNSLILRSTLPNHPPILSGQVTTGNIVNPRICSICQEVREFDEPFLATRLPCCPKCTLKEALLKKRGNTVFGSIKLYALKQVYEWKDYSSFQLRTMFLEQDAYLSQFTVRPFNYVCEMIRLQGHPTPYPAFQPPPLPPFLQRDARVCQNCNTVILDAFNEMKRYSCCARCLMNDALSRGYSLALLNTVKILALKQVLEGNSLEDNQFVLKFLFDRFLEQYKGKKFDYEIELLKYKTREDDNYYEIKNE

SEQ ID NO: 27327 - protein, 240 aa, Candida albicans
VHLYLSKYNLHCLNKMSISISYILEMIQLSILFVFEQLRRITVPNPEKYTPQIESNKIATPLTLPTPDTSIDEGVINQDSFVNTIILYACIVVVFSVGLVSVLKREPHRVAEMDLRVQLPPSTALSIVTSSPSSLAAPIPEPLIKTPTYETILPEIFEFSPLERTPSITSSNYCLNSTIDTTRDFKYTYRGESPALHLLNFSANSPSRSTIVSQVVSEETVNASFTASDSSSDSLRRLKS

SEQ ID NO: 27328 - protein, 60 aa, Candida albicans
RLLQKYRFNKLRQVPNDRPNVTYTVEVQAFLTNRNVRLMSSTNVLLDTINFDVLYKFNQL

SEQ ID NO: 27329 - protein, 78 aa, Candida albicans
SHLLGVYFQSQERSDNVFFPHHPLSTTWPVENNFFFFFGSSHINTQIYKLSEINESVEGGMTGGNAKLSLCATYSLSA

SEQ ID NO: 27330 - protein, 74 aa, Candida albicans
LKKISAALHDQLTSKPYPPQNGKICRSDLRIQLDKFWCKQEECKTAVLTYIGKELFTFISNRETLFIDVVKLVF

SEQ ID NO: 27331 - protein, 333 aa, Candida albicans
PPSSAFQSKISPTQRKKRKASYQQHLSTSSPYPPDTLIDRFIHIQLIFNMDFKSRYESSLTLTKFFGSLPLLVAFPLVFLSHSLSTTSFEFAYENTILLNIFLASACLSIVILAHRLNVLPISNATATTSGSNKMSTMYLLSTFYVIYTSASFLPANRVAVLYLGLFLNSWNLYTPLAFVLDCYTNFKEFYGLHIVFTYALVILGYYLLSSKLNLSSLSNLLSSLDKPTVFGTFIFSALALVFYNPSMFNFSMIGVNLATFIVFMISVQEFQMRDSRLSSVFVSLLLELLQYVVLLQQPSFSQIINIGLAAVVTPDKSYHFEQDEEKGTDLGT

SEQ ID NO: 27332 - protein, 60 aa, Candida albicans
LCWSNCLVIRCVLDNYKITREASLHSCTARAYLKGFAIVERYTIRGGGCFFYYPRYCRDL

SEQ ID NO: 27333 - protein, 90 aa, Candida albicans
SSLVFEILNNNVDAVDFIKGTADTKIKVAIIIDAIGSNPSHEKYFVNIVEITTPTEPKASAIMCKKIPFMLSFIWSCSSSESQLGACRCS

SEQ ID NO: 27334 - protein, 70 aa, Candida albicans
GGVKLLTATDSGIELIAPAYWCSTGECGEDVENTAGDELEFDAMDDDLRDATSSACGACSSCVDRRWVPM

SEQ ID NO: 27335 - protein, 63 aa, Candida albicans
DENKKRKNEKKKLSNAKCSWLYIPILEVYLLFLLRRADSFLCHNTTATGEAEIYSPRLNILFF

SEQ ID NO: 27336 - protein, 215 aa, Candida albicans
THRMTTPTSILSPCDSCLTLSDKSQQYNSQYLMNYLSSRIPEEETEVSEITVVYDGNANINIKLCSVVCLINIYLHKKITVEDLTVNHLFVYLFYHQHNLFNKEIYIDQLKLVHLGKKYQFSTLHSIPSPRLIHDLQIERYPTLLLNIKEDNYLPFNLDVGYYLTCQQTFVDKSTGDVTCLDTLIRKWKRLQNHNNGSNTSKRRGLKNFLKSIMV

SEQ ID NO: 27337 - protein, 115 aa, Candida albicans
MIKYIISNNINNILIRLLPQLSELTYINSTSPEVLLKIEGLDHSLINYEFLNNLQQMVGVINRDTIVIENLLKYNLDEFSLVQLFKKLGDIKQCYIVDNRKIGFIELLCDEVVTV

SEQ ID NO: 27338 - protein, 65 aa, Candida albicans
EFSKKYYGLRDYHIRCTYYVTILQLVKYFVKIYELLVQLNDIYLLFVWVWFPFTNTPNVYIWGDK

SEQ ID NO: 27339 - protein, 80 aa, Candida albicans
VSVVLSIRFVTHFFFLADCGTPLTKKDKKNNNTTINKKRMHQKARLTCLGLISTVGDVQALKIERGWTERQADVEYFRSF

SEQ ID NO: 27340 - protein, 78 aa, Candida albicans
CHKKRWSYFCLMLSMWSLPGYGLCENKNEEYGKFTYVNATRLWSLRKFQLKPRKTYGLDPTRRSSVGKFEQKQIKHDI

SEQ ID NO: 27341 - protein, 66 aa, Candida albicans
TLPGYPLCENFNKTGFLVVYSLFYQTGLKEFPIESSFPCYYGIAKRFSSVFNLHNHTLLLTEQVLI

SEQ ID NO: 27342 - protein, 67 aa, Candida albicans
WLTPDLISILTSGHHKCRISQIRHDMISPETFSLYVLIYYPPTQFVILVISPHIVDFAYMGGLSVNS

SEQ ID NO: 27343 - protein, 64 aa, Candida albicans
  UNSURE (12),(14),(17),(19),(21),(22),(23),(24),(25),(26),(27),(28),(29),(30),(32),(34): Identity of amino acid sequences at the above locations are unknown.
LNEYLCSIETIXKXRIXSXIXXXXXXXXXXKXFXRLPGYFPDLLTKKSQKMYFAVTQSTFIGGG

SEQ ID NO: 27344 - protein, 73 aa, Candida albicans
IINKIGNQLFFFFVCDLNSTIHTVTNAVSIYLIMIKKDIISYKLFVIYNINEVEDNAKDRDFIINPQRMFNPR

SEQ ID NO: 27345 - protein, 77 aa, Candida albicans
KGEIRKEEEVIKEGKSFSIQCNEMHCGRNINLFSHKLSMAAKLLEKKKKKITHKTKKEIKKSPHFSLDTRCSGTGEN

SEQ ID NO: 27346 - protein, 60 aa, Candida albicans
IVTFLSLKHPTIQKLLEFVVVAKKGFQNRKSLSLFGNLQIAPETTEEVLYLTTVANVTIT

SEQ ID NO: 27347 - protein, 71 aa, Candida albicans
NNVYNSSTSFKYKQFTIEGLQISISFAINFRIETQYLFFLSTATYKIRAITCNKVGLLYTGCESINITAHI

SEQ ID NO: 27348 - protein, 65 aa, Candida albicans
GYKYLTYLDMLIYFGSIQPRKSATKYSQESIQNIMEKSIYLSISGIMTVYKNFKFPSYYHYLCLY

SEQ ID NO: 27349 - protein, 104 aa, Candida albicans
WYDFYLFSFFGVVAKFTCYFVLQPQGDGMKIYNPPPRKKTESRSVAANKKHKMNIPAYTLASIERKRKIKLEARFILEKSSVIHSSIIITHNRTNLLQRLLIDN

SEQ ID NO: 27350 - protein, 68 aa, Candida albicans
PTEKSVPPLFGRSLDVAKCISAVVPQQLQQNMVSGQFHTGKKYASSYGGKKTVKADYAAVWIQDHVVW

SEQ ID NO: 27351 - protein, 111 aa, Candida albicans
SPLIVKVYFLSIQLMQSARYASELIQDRISLYLSASSVSISGVRPLKRRYSPQQSIQPTDTTSTSILECTPLESNMKGDLVDKKTGRKVTLKGINVDSTNEITCHSLYAEL

SEQ ID NO: 27352 - protein, 93 aa, Candida albicans
ISPFSPQLEPTFSSEFLQTRAQNFPLLGNNLFPKMAKNVVASKKMAKNPHTKLKMAKKSRTPKKRWQKYVAPPKKSRIVKKKMAKKCRKIGQN

SEQ ID NO: 27353 - protein, 65 aa, Candida albicans
PRMSNFKRAPEQSESHTNKFRFSSNFLANTGHTPRVSNTFPTAAPQPYGCSPFFFFFFLGCLHPL

SEQ ID NO: 27354 - protein, 78 aa, Candida albicans
CLSCSRSNSHEYSGEKGNYIYKDRNGINQLELYKLDWNKEYLVGFEWLPDIDDEGGYASGSGVLLGGYGASLPGGGAL

SEQ ID NO: 27355 - protein, 656 aa, Candida albicans
STMSDHESDNYDSEPDIFEIIVSDSEDDLDMEDLFSAPATGTQNTTMDEECQVEEGVSRRRTVEGHHVSEDNEDYLQRTYGVKSTQYCFRLGKKHIYCRNFIIEERSSGNVVINPTARFYKRASRKVKQDLESVPVHQFTPDEKEIRVDDADLYEMVESKEETVRGMHCVSTQACVGIKKHVKLYMPREVVEGSNFDMKVRDEGYAQVTRSTAVLDQFFSVYEFDDKMSEPDSTAGYIDAGRKIYKAVYDDVIAQHDLANFLGSSLTYHFRNERFVRVLAPETVKQYGTCFGRMLSLIMASKDFDLCERVDTSIANELSGAAWEQMINPLLEWIVSQTADSDTLCTMLVRPYLYNFKTKAWQSVAWCLKYIDALKLMFKMAMFLKSRDEFSSFCSQPQEYGCYFYLQTIYARLVQQRREVVEMEVSGIDKRTVFVREIKVTTDYISKLYHDGVKLYMLEYGSLCRVMGLESSIDRPYNDFVAHAKFDHQSYGLTMNMENNAYLKYDVARHASRKHAIVDLIDSMTRILYVLIFTASANTFRATELSEVNVAANEVLNRNLIYRHGAVEIVTSYGKNRKFTARERFYPLQLQKLIVNHSLSMKPLLLRAMTEIGEMDAIHVNFHRYQLFALSSNKLVERGHYYSTNRTFMKRTVTTF

SEQ ID NO: 27356 - protein, 72 aa, Candida albicans
WVSYLTVLEAVDCVVVKIGVPVGDPWVIGEPGTRQQKKMAEKKMAEKNKLFYTSFFLQQPGNQQSINNQSDI

SEQ ID NO: 27357 - protein, 66 aa, Candida albicans; identical to SEQ ID NO: 27148

SEQ ID NO: 27358 - protein, 65 aa, Candida albicans
QWRSSSNSRESYYNETKNKEISIKKLFGYSQRQLENLTCVACQEIWRSNAASIHDWNYLASDSRT

SEQ ID NO: 27359 - protein, 64 aa, Candida albicans
CLHPRVLIYSVLFSLVEGKKFASSRKGRARGIVDRQRLLMNHMCYKDQTRAVLKLQLCRVLGVN

SEQ ID NO: 27360 - protein, 63 aa, Candida albicans
RYKNQTSADLYLFLMSANHARTVRNEIQLLSVEQKRPFWPYLREPQLCLITTTRPNSTLQKSN

SEQ ID NO: 27361 - protein, 64 aa, Candida albicans; identical to SEQ ID NO: 23307

SEQ ID NO: 27362 - protein, 153 aa, Candida albicans
TIVGLFGICFVLFVVFEMVVSYSVLIRLIKLCKKIVVKENRFNRKRSARKVLKNLLRKIILYGNNYFRTLRKLHKLISVSLTNLLCIFGLGYTTLNSVSVSRDFSHTKSCTIPPQVLLSPHSREYLRQREDTTTLIFPPLHAPASHFLASSPI

SEQ ID NO: 27363 - protein, 63 aa, Candida albicans
IKYSAETKLATTSRYHNILKLMALMGLIIHFQKDLNSNKQLLDYLGFVLYYLWCLKWLYLIVY

SEQ ID NO: 27364 - protein, 79 aa, Candida albicans
LEMLQQKRPFFYPFFPNKFSTKNTKMPCHLNPLDRKTSILMPASSFKDQFEATCLGKKPLDFENNRWYIWKSNRVKVEY

SEQ ID NO: 27365 - protein, 167 aa, Candida albicans
YFSTLASKRVHKKSCCDEKKEHRTVSSLTRMNDLIYETVDANLYVYTIQLLTSNNNVHNINAYFRLLSAKVLSSNFDCLKITTRANILKTLLIYSYPLNIPLQDIIKLAKLIIYSTQSEIESTDEDGFDLEEFSLSLKSDIANTVSLKATANELLVDTNIKCQSLGI

SEQ ID NO: 27366 - protein, 65 aa, Candida albicans
IWCCSFDSVRATNIVEQFFSYNLSAKLTPIPWDAPTINAVFPSTGKLVLENHISEGVLCCIMKVR

SEQ ID NO: 27367 - protein, 63 aa, Candida albicans
KQNYERKKKINPNIVYYSFCKTLNRDSNIDKTKMLKIMEFNILLRNVITHFLSPVPEKKCVHE

SEQ ID NO: 27368 - protein, 64 aa, Candida albicans
KKKNHKRNKSKKKETQTDQVVTTSTTDGLLMVYWKYNMVTVHTHTQSHKISTTKCLRMIRIKGN

SEQ ID NO: 27369 - protein, 67 aa, Candida albicans
SGLECGLGLASSYCLKKIKMTALTITSLTFFFLVSSVFVFIAWERQYSSNNETINHEKRKYPSTFQI

SEQ ID NO: 27370 - protein, 61 aa, Candida albicans
KKKQQKTRREERREKHNLNCYSLTMSSILIHAYFVKCRRNTPKGIRKMVIALTNSIQFCIS

SEQ ID NO: 27371 - protein, 83 aa, Candida albicans
IRSVLVCVCVCVIVNVNVCICVYVYDLVIFDLSGSPICLVVVNSLIHVLMLFFYFLFSFCWVIQLLSFILVSSFVVLLYIHTS

SEQ ID NO: 27372 - protein, 95 aa, Candida albicans
TTAAAIVFDPIINQSIETDKQTSNIRGKLFTLSRDNTQQRSLTLSCISSNNNETKFLACVKLYSIKKKKITSETSQKKRRHKQTKLLQLLLLMVY

SEQ ID NO: 27373 - protein, 113 aa, Candida albicans
GDKTMDAPLKEEEKKALAYLVIVVVVIQMSSLTCRPLLSSPISIHSLIIISLSVIKIQQKDEILKNHTFKKKEEDQNTISFLRLLSVQKDHSYNTSQLYKEGNHFIIHLIIQF

SEQ ID NO: 27374 - protein, 72 aa, Candida albicans
AGTSLNNKMYLLVNYSSNIIRYIAKDSGKLIMKELFYKTTVIRGCLWNGYISVQKTISFFLNKTRYHYAYLM

SEQ ID NO: 27375 - protein, 62 aa, Candida albicans
FTLKSITLLIFLVSLNIKSMNILDLLSIYTLFWSTNSYLSKSATEILLITALAPEAVVATGP

SEQ ID NO: 27376 - protein, 73 aa, Candida albicans
LFCLVLCGQEKSIILPSFIPNLINFHLYFSFNDYKLQNTSDIRRGGINWLFGYFLVYKATQIRPVSLIRPGSV

SEQ ID NO: 27377 - protein, 64 aa, Candida albicans
ISQKFQINLEFSKIYFQFINHYIICEYYGYLSVIDRVSNIYVVKVDCRINVGIMGKRLRLGFLL

SEQ ID NO: 27378 - protein, 363 aa, Candida albicans
YFNHLRVYCCGSLNTHILLYPFPVEFVSGFINFLSVCISFPRNHFQYIFVMASGERNLHSFGYSPNNVDNSATHKFHNILEQSDFSKYYSFQYILSEKNLLDTVNTSIIPQNLPNEFEIIAHLKLIKVLGILKVKVLAGVASYASASRWKQYVTNAVRRFMVFLVSLKKFMDIDLGYSLKSSYNQTHEQSHFQFASMMTQLMPPLDVIMVWYSFLSHPKSFYTVLTGCDMEEFANLPLPLHLINQFIDNTTFEFNVPHEYKHNYLQIIACTTIDTLDSQYDVDRFGFEAKCVTITCPNCKHVISEPIKLQNEMETGFFDKKFATKNIYFGEQSLCYCSKIEVLTHDELRKQHYLQMHQKKNHR

SEQ ID NO: 27379 - protein, 85 aa, Candida albicans
NSQIFSCLPLSRQSLKPTNKSTTLDISSPLLSSFSNNLTIQPENNQTIVIVRTLFLPWPFHRSCAIFFGTYENHEKRFLNKGLVT

SEQ ID NO: 27380 - protein, 163 aa, Candida albicans
YMLKQYQCNGITTKGVRCRIKCQLPNSYCRHHERQSYTHHSNNHKPQSNDTGYIYMYTMTNFLFPPKNWSFKVKNLPDASKKTDWVNFNSRKSHYILIKIGRTTKTPESRIQQWQEKCQHPLTNMGPPNKHLIRKRRGLVERLACMSIDDPVYSSLEKRWVLL

SEQ ID NO: 27381 - protein, 105 aa, Candida albicans
PKWKFHLELGLIVAMLTIQKQQFYPNQTWPDTKHQFPKWIEEYKLVGLEFKNVSNQRSSERAKRPPLVYSHYIPSEGCSKPQSPIALNNSGFNKKSLKPVAWIPT

SEQ ID NO: 27382 - protein, 216 aa, Candida albicans
FFLTFVRHDCLCVCMINSVNGCCCCFNLAGRLSYFFFRCWQKWTEKKIEKKVESCGRVSCPNQALLEFWLILHENSEKFLHSPFSYKYRNMFRIVARAPRILPYRRFTTTPSLRFFDKGPTAEEQAQALEKVSKVVAENPELYKLMVEFKQLLEKKGFETGAKPSMTQMFKLLADKDIREHGAKFKHFLETTDTGLTQNEIATVSGAFLFKNKDIK

SEQ ID NO: 27383 - protein, 66 aa, Candida albicans
  UNSURE (38): Identity of amino acid sequences at the above locations are unknown.
FEGNRVSTTTYKTSQKEYHKEKSSPIKTMFRMRLPYGXEADTRQTSTSEKLSTLKELIEETKMNLV

SEQ ID NO: 27384 - protein, 124 aa, Candida albicans
SIKFTTGVGFCFFNFLCFFLESKPRRRILLFYWFLLTYDFCKMTTISVFRDNLIGFHLKRSIETWMGSWTMSINKYMLVNDKQKKKTCTVIILGEANLMQSHSFQYHTVKKGLNKITYKPVRSC

SEQ ID NO: 27385 - protein, 71 aa, Candida albicans
SLFVSLYKKKINKVDIFIFEETMRIRCERRQLVLLKANGKNKHNMKKYAKKKKQMLPSLFLFYQHLFIFVK

SEQ ID NO: 27386 - protein, 66 aa, Candida albicans
SLTDFSPNSNHSSMAKFTASLKLNPQLKPAWYTRGYVITNSLGFWSAYTQGMPCSTNFSGDINVTN

SEQ ID NO: 27387 - protein, 91 aa, Candida albicans
QSNRLHFVSFFLLTYLAEYMDTSKQTNKTSMNPLPTSFTTSEPINYQEQNRRQLIMNSMENMDYLLMIASQQNKSVEQVKYELKLKLIYGG

SEQ ID NO: 27388 - protein, 240 aa, Candida albicans
QSTGPKMPFQNDDCNSEIKVYVVAVMHWLSEFPNSPITPECSLEEFIQPTKLFEIFQLLFSKEESSGYLTNCFIANKDIQSDIESIYISQITLKQIEILTDILDRHLRSRITLNTFPYLNLYKLIMFNDYAELKKLCQILFRIGTFTSILSANGLAYFEFLTDNDKQVINQFKEPLIKTKKNKYPGLREKSMPPADTNSDYDSADPKSESCYLMQEEELEALNWEISIFENLVYKLAKEM

SEQ ID NO: 27389 - protein, 172 aa, Candida albicans
SFKIEIDFVLATNINISFKPPKKKTENTSTILKLKRYTSTFILTIEPSHSLEDIKYQLCNIINNSGGLPAIQDLEMKNEDEEDIAVPKSEYIDNVDEIKEEVQDESAITKVLVDDIRVAYPKDSTQPYSNNWIELSEDSDIAELSLKDFDILAFAYGSEEQIEIVEPAYEEN

SEQ ID NO: 27390 - protein, 70 aa, Candida albicans
KILMLRFFRNRNLQSRHIPIYSTSKYNRQHGMYRQTNHLKLKLILYWQQILTFHLSHQKRKQKIQVPFSS

SEQ ID NO: 27391 - protein, 271 aa, Candida albicans
VVFLNNVFKYKQKQKIPMSCLLNCNIVLLRTTFDNAWKAAKVIRDAENEIITSSCKISKKLLLLRILSIGKSFELLDNPNIFLEAFNDCIENLVDMGLVFTMMFDSSVVLKLLLIESLLTYSWSHYRFYDFDAKSNLVKLQFSNWNLPHPIVQTRNTIFKILCNLQLGLDTIFAESKEMENDNELKLGLVIRESINHSVCNDYIGYVPMIAQAIDISNIDRNKFFFYEILKLLIVKHGNCCMKEYIQESNIELKTLVQYGLSDDQHLVIQD

SEQ ID NO: 27392 - protein, 298 aa, Candida albicans
IFPSLLHRSIRINESYKLFSVVVNIEKIFQYLNMIEPQDLQRKVNLFKRSPQKPIYKQNLLMDHEEPQYIIDNYKNSYLKIGGNGDGLDNSGNTNIMPLAANAKSIPMRTDTDGLILANAFYIFMTIIVLLILLSAISFGIREYSFAFRRRIKSSTSEALKLNNWNNTNKKANRPLPLCNKIDKAQVREATNTETNNQHETPMSSKNNAISGMTQFTDKEPKIENAQQWCYKEDTSPNYNVPSSHTESEKVYYENEYDSGLTAKSITKFTKKQTIPSLVTIQPKSIYSIDSLMPLNKT

SEQ ID NO: 27393 - protein, 61 aa, Candida albicans
FLTIRFGVFLGLRFATVVHNIQILPDSAKTKQQQQYASIQRFQRRKKKSKQNKNKVKQHKF

SEQ ID NO: 27394 - protein, 91 aa, Candida albicans
LSDTQKQRIIRDWRVLRSISTNNVYSQQSIHIIKTTTTKTVNETLSCPPGTSPTNVLRVSKARSKNRIDSGNSQTSRAHSGGVRKLSGKKH

SEQ ID NO: 27395 - protein, 77 aa, Candida albicans
LYMYVKFISFDNLFLFVICYSFFFASPSLNQCILKVCKTIDLFRIYTFSKLVFFISWFNNFNLFFRTICKSQYIEIL

SEQ ID NO: 27396 - protein, 342 aa, Candida albicans
SLHFFHCLIPMNHPRHRDSMRVFFRPVVVVTCSMILLCFYLFSYKSVATHFDWNDAFDFTRNSRQKIETKFLESPKLEHETNQQQPIVQDVELDYPLNSMVSSFFPIDAVLQFNTSDNGNITTHEMLGRYASFSPILNHRLKSQYAILPFNACDLDNLTSLSKTKYHTKVLIVLRGGCTFVDKVSNLLESEMEPTSILIANDEPYRGLITMFSNTFNQDGSLQTPIMFITNEDYRYLKSIEYQNLTIEISTAYIGSWLSIILSMVLSPPLLIILFYAVIICGQKIRRKQVNIQNAKMVKSLPIYIYNIDHLVLAKYFQHYLKVTGQSNMVPIFTTQWATALA

SEQ ID NO: 27397 - protein, 62 aa, Candida albicans
SFTHLLLIHKQDYRSVATVSPIQISIPTTLFYLDYSCSSTDSNYYIGDIYFLIAIFSCIFPH

SEQ ID NO: 27398 - protein, 62 aa, Candida albicans
SFVLSFVMYMLFILYSEHATFVKKKCVLQHLSELIKKQDYFIHRVDAALYDKSRYSNHNFIF

SEQ ID NO: 27399 - protein, 572 aa, Candida albicans
FLIVCILMVFFFWVFSLLQTFFCKFSTYNYLLSSSNYLQLTFPEKRKSFVDMTIQALPLTALVEYKNNTQESWNKNTKSNTKSNSPVKPAANLVLPPLPPLPPSTPPSKITTNNCTQPTMSRASLTRLEVESGSSKSLPISFPYYFLDQGDPEDTFNLWQRQEDSLTNISNRKDEHLPSQSPTPQVDTERIDSTKKLNNDEVFNPVPKRFSQFIIDQQNPYVSQRLDNLSTISPSMQSERYIMRSLTPLTGTNKKRTGLLVMNPEQQENNSKRTSDELIPPRREISDSMGSQATIFSTRQELHNVPLVNRNVKKSNTIFRRRNNKSKRTSNVRVQTSSSDASVLTRKNAIRSKQGSWLYRLKVRLQRMVAKFKFYSFKVSSRRSASIRRSKSTKLVRKHRENPQNRDMKRIQSIRVSSSRFNHISSPLTNPHLGKQPVFQVATIDDNLKFLAGAPKESVYMGNNRSESQGKLNHLSEYIQQQEQNYMQKMIDNKATSETSKLILPSPDFNDTRSELLTESVTTHVKTIDEPLSRQPPAPPPHLDNSFNNINMGSRNVSLAQQLFPTGLERQR

SEQ ID NO: 27400 - protein, 64 aa, Candida albicans
RTGCYHPGRIFRSSPTARRMGLNEKIVLVSEDIHDTELTTKVKHNLSADIPLTETRKLTTTEVF

SEQ ID NO: 27401 - protein, 390 aa, Candida albicans
VMRFGQTQNSNNRTKRGTGSDNYLGSDTNITDNDFSNSLSSLASSIEKTPPEYINNKPFKSNNTQKGIYVPPHKSKRGASSYRKKGSNLNATLTPEEQEKNKQRLARFAKSKSAPKDEFGLVSRGNDTRLRNNEHDRVEFYRQILFQFVRFCSCSTPNSLHLGLSKLINEEDYQSIDNTDSDFPKPENITMDSILLSTRKLREALLCDPPSAFHKKVFMFSVRISSVLGHYQTYIPSINYLILHRAELDLSDLEFEEIATILILHLVHLNENIPRAIQLYFRYIPHKKEILTVIQSWINGNYYHWVRIYNEERNEAIVSLMKLGHDKMVRRLIKTISCCYYTLQKSDLEQNYLPHDLNFDELVSKHKINWKLSDDGKTVIIRERKKKVVS

SEQ ID NO: 27402 - protein, 209 aa, Candida albicans
RHIPLQRYTKPQMSDKPKNENKLPDILKIDEITSGKIDPQLIYDEIERLKAEINTLRNDMSLFLKALATIPPNQSQTEYYKLVVSRLKKVQDSIDDYCEKYNKLLPIINLAQIKLGHDVEGPPPSKIKSETSTNNNTPNMGNKTTPVMGNKTTPVMGNSSTPSIVTANTNTAAYLTSSNTAAKPTKKATKRASVSNKDMGSSANQPIVI

SEQ ID NO: 27403 - protein, 88 aa, Candida albicans
HLHSIFQCLTGLCRNFPNKIPRNDLPSLLRVTQTYSSAVVNQLISESSLMDKCDLSFLIKMDWLVLQIKEKIMIEKKGKIKKEKEFQE

SEQ ID NO: 27404 - protein, 110 aa, Candida albicans
IRNNFSNLYSKTFFFQFSCFFFHHHSTISAVSPISDHSSPEEVVVQISSVGGLRKLQEKVFFQLQKWKNITPWSKIIPRIIKFVSKNMLPADLNNAAEHQVIPMGPEKIL

SEQ ID NO: 27405 - protein, 267 aa, Candida albicans
LIMNQRNTIQPVRSNNSTKLAVPARHSHTTSVSSFNNASFTTQFLPNQPKPTRTGCSSGHYRLSRTTTNTIGDNYSTQDTQSVVTLDKVPPTKPSATYLDKLWTQIDVLDDVKKMAEEVRSKGSFFNDNFNQQLKKLKELQDKLLNTMSTQQFNDFNSKEHQKQHFYQLNTISPTVHPSDNLFKEDKILHEDEEQQKQEQKKQAKQEKINSFFKSDDKQEDLEFKNQTIYRKENFEEINQYVAQIKKDLKGLGESMKEFDESTREIW

SEQ ID NO: 27406 - protein, 60 aa, Candida albicans
ARGRFDLTSEFYSQFFFFRFCRASRIFPNTPGVKGKLQKYIIKEAHILICNVKFLTYLFL

SEQ ID NO: 27407 - protein, 60 aa, Candida albicans
QRNYGCGQCRIITIFVDKNHSVFLHATNIFLNWQDLFYFCLALYDINMIIVGICLSYVSQ

SEQ ID NO: 27408 - protein, 62 aa, Candida albicans
HRYFPIRFFQFKESINEHEVVDGNYIYTPYCVSNIEIANKIHFIGLNLGNFLRVVFSKLDIS

SEQ ID NO: 27409 - protein, 69 aa, Candida albicans
EIRDLKRQEIERKEQQKKDKLEGKKDELRSKASVARSTRRKNAKASRADEESQEQEEESPKKKKKVSFV

SEQ ID NO: 27410 - protein, 102 aa, Candida albicans
SNVPQRKTVPAAFQSVVPRNNIQAPPGIGMKNNPTGEAGNKKENTPKTLNIAPDAPNEATDKDDPKNIGIANEANEEITAEFKYMIVKLDTPKNATKVEPND

SEQ ID NO: 27411 - protein, 129 aa, Candida albicans
GIKIFEFTRLLRYYLCTYTNKRRYTFCYECVVYIGYVDDYVIIVSLAKVHKIIHSLVKSFFPIQSQGNSNVYLYSREECTTAHMLFSPILPCGGKIKTRQPGGAVNDHKSEASPCQPFYARDVFATELN

SEQ ID NO: 27412 - protein, 68 aa, Candida albicans
GTVVDKRMNGGKLVLKYLAFTRTLSKGFYSVCIYIHFIAIYLLIIICHKTTTYQFIKRILKAYTVCIG

SEQ ID NO: 27413 - protein, 72 aa, Candida albicans
FLLLFTIKRKLILSLHKIKKNGNYERSRRLKNNRNSKKEPCYILSSLMYRTTNTNNKMTTFSVPKCITSLYF

SEQ ID NO: 27414 - protein, 258 aa, Candida albicans
KKNYAQQQTRTSPLMGMDKKKNVGFGFQNSTHEYLANHFKLHQMFIPGFLTLLLTILASVEAKKINLYIKPIDSPSKGDSIGFINDDSVYLIDSTTTLQPDQFYCVGTKDLDNHECFTLINGVESLNGTVIDAFMDENGVPISRFSLNLDESDNNKSKLRKHKFNTSPIPNLNPDSLKKQRQKQGNKGGQGNNKQVEIIKQKKLVKYIDDDGNEAEKEIEEEIVVEVDNRSWVQKNWMYIVPPLLLFLIVGGGDQPQQ

SEQ ID NO: 27415 - protein, 69 aa, Candida albicans
FSLLHKSYCCFFFFFVNIDSEFILLYKPSFYGQPTNKCTPQTPFPATFSAYGTTRHVILRCLIKVNKNT

SEQ ID NO: 27416 - protein, 64 aa, Candida albicans
HVPRSKKSSLWNAWIVKDFYSKKMDDYNAFFFTTGYLMLNHTRLHVENFFFLRFLYILKSFFNF

SEQ ID NO: 27417 - protein, 105 aa, Candida albicans
LFLVELKQKILTMKFTVYSSDYIISYTSISPSSSVKTNSSKTFCFSWLSLRYSYFNSRLPCNGQINPVSPLTPPRVTVHPKQISIGLSLLFLSSLSGDKLALNIS

SEQ ID NO: 27418 - protein, 204 aa, Candida albicans
PKILFLPYNDQLQYSFLTCCFKLSTYPKEANLKIVSAQDMLAALERAEFSGFIPEVKQKLSVFEANVASKKQLKAAKPISTEEGEKSVSKKPKLDNESMEIDTEDGDGGKNASRGDDDDDEDDEENSTDGNEEDDENSKQDIEHEDEQDEDEDDDNDETEEDVSNPISALAKEEQELQGVETETEAENKPDSSETEEEEEEEEE

SEQ ID NO: 27419 - protein, 71 aa, Candida albicans
YIRRLGHLGKQFAWIVLFVCLCFDLIRFISFIEFFFFPCTLVIKHYNTPTVSNLYSSTSSFTIHTNQELNI

SEQ ID NO: 27420 - protein, 88 aa, Candida albicans
AMATTVIKSRLPSWFDSNFFMKYIESFIVLLDEIGIDPINVLDALIKPNSCETISEQLILLLFTRCTRFEFSYVYKVVEFIVKVQWIT

SEQ ID NO: 27421 - protein, 97 aa, Candida albicans
ILSQKKKMIHTMSNEMAEIGFAIIAKRHVQLVIDPSPPQQLQALNLSGVKHPHLNELILVYFPFIYFSTIRVDFSYLLYIYPCRKKKSSELFTNQLS

SEQ ID NO: 27422 - protein, 77 aa, Candida albicans
THILDHLQIMFRKKDKDKDSDLKAKDHSEVPSATTTEKTKQEIYHEQGLIGLFHTMKENMKKEDTKDLDDDIINLFG

SEQ ID NO: 27423 - protein, 346 aa, Candida albicans
PMINNLQEQVAWVKRTNPHITPQAVIDLIRKPFPKDKLAPIPQVPDSIPSSDKENIPISKSQRKVQSRLPLKTISANESTLQSTPTPVNKTRLPPETSDIIDLTHSPPKKRSPPQPSSPIQPTPKKQKLDDSVFRKLLGLHESKIKILEEKFLTSESTLISLDQKKELYKKLERQIELLDNEINALKLGLDDSTELSSSPDSPEFRVPITRPVRLEAARTIVESTENEEDDTEDHFGDQTMDGLLTPTQERMSQDDLNEMASFIDDRTFDITSQLSDGEFIAVESDTEINDIRLSPETATKYGIKYNSQVIGKARTEVSSPISRVPAIPEIDSSDSEPELPPIRRR

SEQ ID NO: 27424 - protein, 71 aa, Candida albicans
TSPSSLLSLNSYDGTIEEVLELDQPQLKKVKLEPSVSTSNSSSSSPTQFSLFNDYNLDMIFEGVVDETVNV

SEQ ID NO: 27425 - protein, 93 aa, Candida albicans
QKKKKVPFASLSFLFAPQSTTLMNAQRLKNLISLRSRNASNKLQRTLQELAQNIQRQIQQQQQAPIPVPVPVRHRNTHPLGRRNYSTITQSRW

SEQ ID NO: 27426 - protein, 89 aa, Candida albicans
PIPHSHDELKKRKFDNVNNNVFQKSHYKYKLILLCQKKKIQLRKKKRRAIPFFLFCRKPLKLLNLFWTESPVIDTIHNVEEELIYLLND

SEQ ID NO: 27427 - protein, 63 aa, Candida albicans
TMSDKGNMAKDIASSVVGSIGGNKVADKLHLGGVGHIVGGVAGGIAGQNLEHKAEDEVREHKG

SEQ ID NO: 27428 - protein, 212 aa, Candida albicans
STLSKLPNNHSNTINDMSLVQSAMFNHHMGPSHTRSRSFELFQEAKTLRVAACKRSYSDDLNISTKRARTAPPSPPYETATPTRASRLVISNLVKPTSNLRSRSLSPNKKFSSPLSPSSSPIATVTSPISSPQNIKIKLPSISDALNLPPITSKEPVKLKPIVPTVSLDYFDTYKPNDKNWRYGLLDKIAKDSKHFHLNQYNYLNDHVKTSF

SEQ ID NO: 27429 - protein, 67 aa, Candida albicans
SILCNDHNQTRLKVLLERMVTVYDYAKYTTATPSVGNKIKKKNLFPPNESRSNASGLARKCTCWVYF

SEQ ID NO: 27430 - protein, 92 aa, Candida albicans
WLGKSGNVESEIQATIYITPLRNLRLLSISVVDYVQEYTCVPIDECERHNCAYKKANKGLKLCITVVLSCKSVAWSLVMMMMRKIQRKKKKI

SEQ ID NO: 27431 - protein, 64 aa, Candida albicans
CCIPGILIYSRLFSLVEGKKFASSRKGRARGIVDRQRLLMNHMCYKDQTRAVLKLQSCRVLGVN

SEQ ID NO: 27432 - protein, 64 aa, Candida albicans; identical to SEQ ID NO: 23307

SEQ ID NO: 27433 - protein, 64 aa, Candida albicans; identical to SEQ ID NO: 23307

SEQ ID NO: 27434 - protein, 88 aa, Candida albicans
QLLYIDLLKVITIESRAHAGYQRSINEQFNRQTRSISKDVNSMSTTFDSHTKTAFFVVASPIIRLPQSPSVRIINICLGFKTVLVWSL

SEQ ID NO: 27435 - protein, 77 aa, Candida albicans
  UNSURE (66): Identity of amino acid sequences at the above locations are unknown.
ATNRHMIGYCSLPLPPTLQLSFLTIVVWMQLENIGFLTISPPILDFLRPNLDCQLLTTCAFKVTRXWDVVARSSLRW

SEQ ID NO: 27436 - protein, 83 aa, Candida albicans
LLHVQVVQHVVKLQVGVVEAAVEDAAVEDAEQLHLVGVGVEVVEVGGAVEEDVVVEVVATNQFILSITSISGLLIFVKFHICH

SEQ ID NO: 27437 - protein, 70 aa, Candida albicans
FIKWYIYIYVNISMYLFIYIYMYVLPDFKVDPIKTQFLYWTSFFFLSFFPYISTIYSTLSTQLIPVVFPS

SEQ ID NO: 27438 - protein, 108 aa, Candida albicans
KPIMALKLKLKMPSSSASNSPQPPPPESHSPEQPKLPKLKIKAPSKTPVSSTPDSSMALKRPQEEQSTGEKPKKLKLSLSKTKENGRPKGLPPFRIKPTRIPGRRIRF

SEQ ID NO: 27439 - protein, 79 aa, Candida albicans
INGKKKVTHKQRCVCISISYGLRSLVLREFIVKNINKNINKNSKKYKYKQLHPKNNEAWYLVPHIQDFLSRNSLISSLK

SEQ ID NO: 27440 - protein, 253 aa, Candida albicans
HIIDLFTQIVSCNDKLELHKIQVELDEISKNSTTPDQPSYIQKLTTDKLKILNNLLQSKQNQLSKRRFEFKGEPVAPVLKSLVANDQNVDDTSKSIQKINNQILEISLNEHMVVDCFSNSYVQTTNEIPSIHLKGGDRSICKLTVQGPVFIHDVRNSILVLSCHQARLHNIHNSLVIIQSVQNNRIIIENCNQIKVSSGIEVDDFNFPTKEIKNPHFEVLMRDVSDEVLNGVRRIAQTSDIATVINKYIDVYH

SEQ ID NO: 27441 - protein, 86 aa, Candida albicans
STHHINLLQIRSLCEIILDSFLGNSTIFFLPLNTPLSFYGYFQIMYERLTASSYSTVVTTCRNLHVKKQISSRDEIVDRYTTTLSK

SEQ ID NO: 27442 - protein, 60 aa, Candida albicans
CHQYFFYSRVYRTGYDFLNYNVELFGRVMSLFLCFPPPQHQKNIITSEIVSMLPLLGQNR

SEQ ID NO: 27443 - protein, 88 aa, Candida albicans
IRVLAISAYVVLYFYSSYDYPPLSPIYTLKGLILTPRVITDSKKNSLIRDFSLQKGTGDILKFILLSVSVNACYFSGRDWKESSVKLL

SEQ ID NO: 27444 - protein, 73 aa, Candida albicans
VKANSHENGLFVLCSLLVIHASLNIPRGLMLARVYKPWVSFSFQLNYCFFPVFGCVHHSFSCWYSIISSLETA

SEQ ID NO: 27445 - protein, 147 aa, Candida albicans
ISSIVLPFISTTYMEQQIHQAVEIALSGTADPTLKNQAFEFINHIKSTEEGYKACVDILIKSSNESINDGLKFFVYQVIDENIDKLSQDQVFTLNQELFKCLSSYINNNLQEPYSFEKQVCLKFLAKHFCQVYIKHLSPLLLQICLN

SEQ ID NO: 27446 - protein, 62 aa, Candida albicans
FSTRVLYLCLYCIVLYIGVDTRTPAKKKNRTQPTIVSNKASELFFLLLSFFWFTPFINNSRI

SEQ ID NO: 27447 - protein, 71 aa, Candida albicans
LSTLKRAEVLSFLQRGTQNCRDFYDMIVYTVAIRNHKICTVLDDYHTANITKQKKIHNFYRFMDDMRNTKN

SEQ ID NO: 27448 - protein, 103 aa, Candida albicans
WGILVGKSLSINTGSLLSVTYCMMLGGKFCGCESVMRIGFAPDSMIETILVLETAEYPINKWVSPVVMLEVSKLVMLENECIRNTIKVRNLLFIKINDFESKM

SEQ ID NO: 27449 - protein, 73 aa, Candida albicans
KIYNAGANTNATKIFQVLITSLALILTREAARASFAFLTEIFFEVMKTGLNKIIPGKLNPMNNENLKNLLTNI

SEQ ID NO: 27450 - protein, 93 aa, Candida albicans
KKEKNTMLAIFYLFVLCLCTPVPADTELKAVTNILGQISAPPSTSTLTERHTIEPLYKIDPSAKPSISFNNKDEILNYERRLANEGKKYLLGK

SEQ ID NO: 27451 - protein, 68 aa, Candida albicans
TSSSPHTKSMNTRNLQVLIEELGNLILLRSRGNQKGLKTDSGYCFIFLLDIEFLFFWLLFSFYFIGGS

SEQ ID NO: 27452 - protein, 123 aa, Candida albicans
INYHFLSMRSQSLPLPLIESPNSIDLDPINHENLAVYGYLLLISTWMLFIISINSIFEIWRFIIQPLQSSPTSLLLYDKLTISFETIDSYIIKLWCIYVVCWWWAIVSWSGLKLFRHSKGIQG

SEQ ID NO: 27453 - protein, 97 aa, Candida albicans
GRTRPYISQMAGVRSNFKSIDSHENYSRSRCHCRGPFANKPDFEEVYKIYQEPIAKKKVDLLIVLVFYFGKSTFFKPCLILLRYITFLIKDIASPLF

SEQ ID NO: 27454 - protein, 76 aa, Candida albicans
TPHCGVDPSDGGRVESEFICKIVKYNNIEYISIDKVLESMINSKVGEANHPIRLLPKVRRYGSGVVGLHPTSSRGR

SEQ ID NO: 27455 - protein, 61 aa, Candida albicans
FILKVGEPNSPIRLLPKVRRYGSGRLDTSNSYDPHQYTIIYINNHITSNTCKYNIVVSAPT

SEQ ID NO: 27456 - protein, 74 aa, Candida albicans
VTVTPEANNIIVLSNGNSAGDIVGIPTGGHCIPKSIVGFSAECRYAQNNEANINISLTTNNRNPWLSPRLTAKV

SEQ ID NO: 27457 - protein, 64 aa, Candida albicans
IIILPPDPTYSRIGLRLTCIVVTYRYPHIHSYLYLYIPPTSLGGGWLVLYSLYRVLYYLYNYIL

SEQ ID NO: 27458 - protein, 100 aa, Candida albicans
GFFGQGWPYIIVRLYMYYTICWKLMYYIGILITSIISLTGPIPYYIWYGAHRGSSSIAYTVKILISYTLSIINNQQITNNNNYLVGISETTRVKTIKFNQ

SEQ ID NO: 27459 - protein, 82 aa, Candida albicans
VIGVVIFILTMAIAFMGNTSYNSPKSFNYINLNKSNLNYINLSPFNKSINYIHKRYLSTKSKSNDILEPSDIFKEIGIEPVV

SEQ ID NO: 27460 - protein, 83 aa, Candida albicans
LWVYKPITFIMGTLILEVHRQTSTSSRMKCNTLDGYIQVQWIMLFNWMIPLTPYQFLNIYSLPERVYTGVTLLSSVHAKWYFI

SEQ ID NO: 27461 - protein, 78 aa, Candida albicans
KSVPTILSSLYVVDTDSTMAIGSNAISNGIKGININTITKGCIPPVGLYSIFNKDNINKNNIAMAPTYTKIYKIPIRT

SEQ ID NO: 27462 - protein, 61 aa, Candida albicans
SVKNHRQIYLLCLLFNGNLVLPTRLYQLMKFIGYINLILLKNNVNIIKFKDYIKRPSLNDT

SEQ ID NO: 27463 - protein, 79 aa, Candida albicans
ILGYTDAKGTFSVNMTKLGTYRVKYILRERYECNKGVLEYILGLFSKEMLHRPQDSKAIMGPGSGSLGAVTQHHNTPNI

SEQ ID NO: 27464 - protein, 62 aa, Candida albicans
LLYIIDNNCKYILSYYNKYKLISKKIDTYNMFRDILVSDSINLEDIKYISKSMGNINRALQG

SEQ ID NO: 27465 - protein, 68 aa, Candida albicans
PETNSDSASTLSKGGRAHSATQPIKKIIAKGNKGIPYQIACCISIYLDTFIVPPISIHNKMIVVRTSS

SEQ ID NO: 27466 - protein, 82 aa, Candida albicans
RNFDPLSALYAEEITCSLYYTYVLSRLVSLLIIAQLGYYPYHLIYVIYILLCTSYNLVLLYLVILLYSYSYIMNRMFILIIS

SEQ ID NO: 27467 - protein, 95 aa, Candida albicans
QYSLIVKLHRVFSSTCCYIQYLHCKYYFTELPVDTSIASCNHSCRTPIIRQGISLPSDPHDKTAVNQYIINYLTSTGQVSPTILTFHVSSRLCFW

SEQ ID NO: 27468 - protein, 65 aa, Candida albicans
ACIIAIPTSKIVIAITATIGTIPPINPKIDDDIKLTINEPKINISKCPDNILAPRRRPSDIAREE

SEQ ID NO: 27469 - protein, 66 aa, Candida albicans
KTLFKYIKYIIRYSYLSTVITLIIARGSHACTPDQRSGLHQRLNMIIHKRYKSKVNNRNNIINKEK

SEQ ID NO: 27470 - protein, 60 aa, Candida albicans
TVGRSPLRGLRSLQTASMMGIYKMLNVQSKSHLPKRSVVILNMKYLLHEYKVIECIYITY

SEQ ID NO: 27471 - protein, 73 aa, Candida albicans
GSIMSVISVLIGLYSVLVQLTNGENEREEIQVTPDYLESNNTRDVRDSDLELITSRPAQYHTFSELPILIQQI

SEQ ID NO: 27472 - protein, 91 aa, Candida albicans
SNRLKRDLSEFKSQHRHTPPPEIIDLGWTLTHSIMVVHITTDNDIGVRITLRRMLLLTLVTYIVYIAYNQRDILHINRLAVLALSFVAYLA

SEQ ID NO: 27473 - protein, 62 aa, Candida albicans
PRYIMYKDIFITRPAPARDLGSRAGYVDIYLIGEHTSYRLYLISHLFTRSYICRIGSVAYII

SEQ ID NO: 27474 - protein, 86 aa, Candida albicans
VTYNILILLIIFLFYDSRLMVDPGTSNATVRVRFTSIVFPHYVLAGAENLLQISLLGFNSLHSVIYSLKSNTYVSYFHINIDINII

SEQ ID NO: 27475 - protein, 63 aa, Candida albicans
APPLHPIHHLQWWIGSRSLITVNIYLYTYYLDIFAKGAPSPATSILIVCPILLIEYHIYILYI

SEQ ID NO: 27476 - protein, 71 aa, Candida albicans
YIVEVTYYIICLFNFSYLKDRTITYRNLNLIRLLISTFSLYGILHAYEGYHGIVFMNNKPLLPPEIEDLGC

SEQ ID NO: 27477 - protein, 69 aa, Candida albicans
YLLLSWKATSILALLNITPVKPPIVNKNRKPNANNIGTARRNSPPYNVANHEKILIPVGIAITIVALVK

SEQ ID NO: 27478 - protein, 65 aa, Candida albicans
YRQRCLPPRLDIVEYKWGELQESLRVITTRPSWKVGWYYGRTYDDLQRSIIYTYNSTPLELGYKE

SEQ ID NO: 27479 - protein, 64 aa, Candida albicans; identical to SEQ ID NO: 27457

SEQ ID NO: 27480 - protein, 62 aa, Candida albicans
DHESYMLPITLYCVITNIYNNLDPCHIILIIPLGYKPYHNVGIIKAIINKLSRYVQSLVNAV

SEQ ID NO: 27481 - protein, 70 aa, Candida albicans
GVRIPPVNLLVTFNIYAADNNTENADIHPNIVDLPIAPVRLSNSPIKLTVNGVPILLNDKINKYIAKIGI

SEQ ID NO: 27482 - protein, 82 aa, Candida albicans
TTGVYRTVASDRVGIIKRIIAYTANLSITPANSIEPASGLSLCTTGSQVCTGTKGVLTIIPAEIHKNRIHCRSVDSTTRLTA

SEQ ID NO: 27483 - protein, 77 aa, Candida albicans
HRLYIKHHFRYPLVVQSVAILYITDGLITLTVFTNVAVSTRPTLSRSGDYTNRLSIIPLYNIPYKSYYYIINYYLSR

SEQ ID NO: 27484 - protein, 60 aa, Candida albicans
TNTLYNPINTDITDMIEPHELTTFQPTNASGYCGIRRGIPFNPKKCIGKKIMFTDTNNNQ

SEQ ID NO: 27485 - protein, 100 aa, Candida albicans
CRPDLWSGVQACEPLAIIRVITVLKYEYLIIYLIYLNKVFHASNDIFSNSLILTVQPVPAPVSIRTEAITQTNAGGKHQKLMLFRRAKAISTAPIIIGKK

SEQ ID NO: 27486 - protein, 79 aa, Candida albicans
CFFYTHKKILCNPRKKITSIFYHTKNYYVLHAHKKLPYKKLPYIFSHTKNYYVVHAQKITIQKNYYVFSHTKNCHTKKC

SEQ ID NO: 27487 - protein, 84 aa, Candida albicans
MHVTHTIFNHQQHTKNVCTLGVENISPGIIVVANYSGVFVISIGVLLLCGKIEKHKTVQLYTNKWYTHGQTTPNNTPVMVGLAK

SEQ ID NO: 27488 - protein, 119 aa, Candida albicans
GFFPYKKIPYKKIAIQKIYYVLYAYKKLPYKKILHNTPYKKITMYFFPYKKLLCILTHTKIYYVVHTQKNCHTFFTMYFFPYKKLLCSAHIQKITSILTHKKLPYKKMLVFFLHTQKNY

SEQ ID NO: 27489 - protein, 69 aa, Candida albicans
AHRCQPAMVQRLKSLIRIHLKCAGQKSSRSSMDSDLEAFSHNPADGSFAALPDQTAAKTNYLNERFLSY

SEQ ID NO: 27490 - protein, 91 aa, Candida albicans
CFFYTHKKITSIFYHTKNYYVLHAHKKLPYKKITSIFSHTKNYYVVHPYKKLPYIFYYVFFTIQKITMYSHTKNYHTKDCHTFFPIQKITM

SEQ ID NO: 27491 - protein, 79 aa, Candida albicans; identical to SEQ ID NO: 27486

SEQ ID NO: 27492 - protein, 60 aa, Candida albicans
SFAPIPKFDDRFARQNRYEPPPEFPLASPYSGIVHHLSGPNSYALTQIHPNTSGSVDGAP

SEQ ID NO: 27493 - protein, 62 aa, Candida albicans
GRNDAQTGMPSGIPEGAMCVQRFDDSRISAIHITYRISLRSSSMREPRDPLLKVLTISNNLV

SEQ ID NO: 27494 - protein, 95 aa, Candida albicans
CTHTKNYHTFFTMYFLPYKKLLCILTQKITIQKIAIHFFPYKKLLCSARTKNLLCILTHKKILHNTPYKKITSISPIQKNYYVFSHTKNHIQKKC

SEQ ID NO: 27495 - protein, 77 aa, Candida albicans
CTHKKLPYKKITMYSHTQKIAIQKNVSVFSTHTKKYYVIHAKKLLVFFTIQKIAIHFFPYKKLLCSAHIQKIYYVFS

SEQ ID NO: 27496 - protein, 86 aa, Candida albicans
GLRIGLGKGATSFWNREAGQTWSFRGSKSRNKVSVGEPAEGSLLICLIAPHVFFFETNLLWRWAQPAARGLNLQPIFYQLVTPDYY

SEQ ID NO: 27497 - protein, 63 aa, Candida albicans
RKGFVRLPADSNVNMRGDKSFAYDLDVQRSIVSSRVALLLRSAEIKLLLSDLSKKTCPKGGSV

SEQ ID NO: 27498 - protein, 79 aa, Candida albicans
SWVERPLVQILVVVANIQMRTLKTEVGKGSMSTAVGHGLVDPKRWGSSVSTCLIFQANHRKGIRLKFRNLDMDSSRQRN

SEQ ID NO: 27499 - protein, 87 aa, Candida albicans
PSATKVGSTMGATCPLRKVATHRNGLPIWEASRATRATKVLWESWVQYTLLRNELPIREASRATRARFQLPIREASRATRAGFQLPI

SEQ ID NO: 27500 - protein, 63 aa, Candida albicans
MVNNQQIGQFLRSHFMQCVCRIQHMIIPSKHPIQIYPNNLIRSLLDYKIPLSITDTVYDLYWL

SEQ ID NO: 27501 - protein, 61 aa, Candida albicans
LLLLLLFQLDDWKCYIQDNLFCNNVPFIAFYPKRENRYFSISSNIYLVLPPVNITNFILTM

SEQ ID NO: 27502 - protein, 61 aa, Candida albicans
LDIDRPWLLKNYCFRDSLTQSPKQLSAVRYNLNQFSKSVNQSTLMSSSWYSLRILVLIAFY

SEQ ID NO: 27503 - protein, 101 aa, Candida albicans
LSSLEKLSSCYDKKLVVWQAKKIKAPMRGIEPRFARRSVPMKEMKANRDSHYTTSDYLLIWNRLAFLYWLYYYGFLNFLKQVFFLLQCKTYLIRNLFGFKK

SEQ ID NO: 27504 - protein, 74 aa, Candida albicans
VLPFTKEEVRSLMQFWKDQGVLIVREDFHEKDYEKISDSPEINIDEQFEKLVQALYDNNQGNPYGMIKQAVLSY

SEQ ID NO: 27505 - protein, 273 aa, Candida albicans
ERISFQSGGVRVIIYYDQPTIDYNTISSPSKQPQQPKQNSQNNKPLDKPRNQTFGTVIDYSDVEDDDGDDDDEYPDLDDDIKTNTRLINQWRTNNIQPTTFNPTINQNGSINRQPTLTNVSLPDQYPGKFPHLKNDNDVKQDNSVNLLEADKEYESLIDAKIQALQREIDNNDNDNDNDNDNFPQNVETTNVLDEINNLQLKITSQTKTLQELNELVDVYEDEIQSNNNTIITTTGKLIIDYKDYQNLKNEYMNELNRVKKLYEAYYLLFNGC

SEQ ID NO: 27506 - protein, 69 aa, Candida albicans
IINYLNCHKAGKEYYRIKVNYRLGKALYINWFYNKYVISIGSIEKFVVSLINFYTKTSRRNNYCQRLKL

SEQ ID NO: 27507 - protein, 275 aa, Candida albicans
RKALLNGMYTRRAIHMDDKFVFRDVLDTFPRLLKETLSINGTLSQCEGIKAEALLNLFFNTNLRFDSMQLNGLWDPATLPSVATSIRLFHTTLNSYVIPGVKKLDMEMYSNTRESQTYTFSPDLEDLRIDFNFTIQVTLPPNLQKLCITTSLDSANFVSPELVRLEYLQLQLKNIQSFDETGIIAPNLKILDLTGCFKMSNFNGLKQFQRLKRLRLKYCVYPVGLFEECSFNELESFEYIGKGFPVSCDVSCSRLTIPSNLKLPLIFHHGLADPH

SEQ ID NO: 27508 - protein, 122 aa, Candida albicans
HLQLRSEYNKLLIEVSYIELIFLHSSCIIDKLYKCKRKRNTYTYLSFSLGFAYNNKRPAMAAKLPAPATGAKPAPLDEPDLAADEPPVADEAPDLAAEAAEETPDLAAEATEKTPDLAPKSN

SEQ ID NO: 27509 - protein, 198 aa, Candida albicans
  UNSURE (194): Identity of amino acid sequences at the above locations are unknown.
EFSYKVQFFIMSFKNQFNFNISKSTPTTSTNNTNTTSNSNSTSNDNPQPTTAKPPPFILNILLKSNFDSSVSTNNSSKTPPKSSSPRLSATGVVPAVVTIDNGEPIGNNTSNTSTDSSKTDLIGLFDKFDINKDDKEQTKPEHEEHHPITEKHEDDEVSHEDKLEKMVLDDDGDDGESHKEKEVVSVLQPTGPXGQAN

SEQ ID NO: 27510 - protein, 159 aa, Candida albicans
  UNSURE (151): Identity of amino acid sequences at the above locations are unknown.
NEQNQDEIIKDPVEITRNNLQILKDQVSNYISFVKDNKISLSRDAFLYLKSIKSLGVKKDTIKDYFQIVTDNNLLNREGSWKVEQLSNSTSTSNSNSNTSNNSNNNNNNNNNSKSFRYTKNLTIPLTILNKNNVNLLPSFQSCLVGRLYWXSPRPGRSN

SEQ ID NO: 27511 - protein, 162 aa, Candida albicans
DSEENASSVPLTDLTSPSTGETSSQQQRQRASQQQPPQQPESNTATGSRWLNFVDSFKPAIENEKLAMRYRDANADVEADAGGYYNSTDQLTEIQRININSSKSNLKRKLKNRHLQMIAIASSIGSGLLIGTGGALATGGPGGILIAWILSGISILCTIQAS

SEQ ID NO: 27512 - protein, 105 aa, Candida albicans
LLGTTNIHSNFPLINRITNNNLYNTNSGHSIQSGEISNLYNRMGEPYITVTNNPKPEHISRFGTSLSPNSPGTNGPICDTQFPLTRMVPYLMESNIFIPAHPQGK

SEQ ID NO: 27513 - protein, 241 aa, Candida albicans
  UNSURE (15): Identity of amino acid sequences at the above locations are unknown.
EMIIHLFHHQHPQIXTLSWYVHITIQYYRKTSETSSSPPGNGKKKRGRKRKLSLDDIQIQIDNYKIYNCQIKLNMSHNDEKFDVRLQFVYKTKPKVTTTHHHNHPKNNSKDSNYINSGNHARNGSQNHNGNGVSSRDANSSFSSNNNTSPNGLAKLLNPSPTTETSNLRNGKTNHSIAATGSIIPLEEEEAPNMYITYDELINYLRDKIFFKENKKNLRGIEVKINYLLHLCTFKCLINET

SEQ ID NO: 27514 - protein, 68 aa, Candida albicans
FPQKFVLSLYNNLKYRDRIKISSVSFNNIFLYISNTVYPLPDKTKSKKKKHFNINLYVQKGLKYTLFC

SEQ ID NO: 27515 - protein, 69 aa, Candida albicans
CFKATSTQIMFNSIKYKHTILDNENPLKGTSTLVTLVSSLRNSFQKAYFCYMNFQLYVTTNKFLAMTNR

SEQ ID NO: 27516 - protein, 80 aa, Candida albicans
GEEGEKEKKRVRKRTGGKREKEPKRRKERQKGGGGKREERGEERGEGGSQRRPGKEEEQEEGGNEEEKVARQEGHIPPTL

SEQ ID NO: 27517 - protein, 74 aa, Candida albicans
FILTLLKMLYMFLFQMAKPLIICICLFIRIYTIVPLNLLMSSIDYWKYGIRTLIEILRMIFDKVVSFLSYNFTL

SEQ ID NO: 27518 - protein, 257 aa, Candida albicans
NEYSIMIQSVYPLIYYCFDMFIHHNADLQAAKYYYLKVIQLLGNNHSINLATANDNNIDEILEISWNSFIQLLFGVPSRSVAPKGKFNELYVFATLNLTILLDYEHGILKDKTPSYAIQLKHKCLDDLQQAFKDSEPTITNAFNQNFTLKSDILHITYNLVLKVLFEKQVDLEFDTKLRQMLETLGDKSSFAFFYILIMYLLDFKIKEEGQNSTMEKQKNLLQQYQEKLKFDNDTELICKLLILKILCFHHAVARPN

SEQ ID NO: 27519 - protein, 87 aa, Candida albicans
NCRVLVWLHMLQDEFTGTKQMKYNQQLLKPRKKKDRILFSGYFNIFVCTKLRLSLLNKFMKTTNTSTQMVFGETITTHYNLVNKDAR

SEQ ID NO: 27520 - protein, 155 aa, Candida albicans
YWFSHYKYAIINPSKLLKTRKIEESTPPLTKSPPFFFFEDEEDPRLRRTPFEDDPVVVLVCWVVENVPPLVWVLAASPEIPLTLETEAASLNPPVQQYSWKHFLHSSDCSSPNRSCCLLIIAQPTHVDQFSSSVKLYLVTVSNPFLIAPNFSWSE

SEQ ID NO: 27521 - protein, 101 aa, Candida albicans
  UNSURE (10): Identity of amino acid sequences at the above locations are unknown.
LITHLLIYPXVPEIDSHKFHHTTVNYSLLLTNQRLTKKKKIYFSILTYWNIFKLNFSPSFFKKQIKVNYFKFLIFLFVLLLLLLLSSLQIQTINSNKYDFS

SEQ ID NO: 27522 - protein, 68 aa, Candida albicans
AGGIIPTWWSSWYWWFSQHFLSMGFYQFSIILHTTISLKFYPVAEDMAFLTTLKEFPNTFYCGFHWLP

SEQ ID NO: 27523 - protein, 66 aa, Candida albicans
NRYNYLFFNCSLFWWLSIHDHHLPTTTAIINNPHQVSNTYYLLYPRILLKYTISNEILQIKIGVWP

SEQ ID NO: 27524 - protein, 86 aa, Candida albicans
KIFDVLIYTHAPPPPIHGRFVSSLSFGLFLSEFFNTLNFMESTHTHTQTQQLLKKIYNFNNLLTIDYCVYYYYIKLKNGIKVYRKG

SEQ ID NO: 27525 - protein, 60 aa, Candida albicans
FAALSDWFSKVELKYDSRYLKSSRRILFVQRSIRSVNRLLNESFGQLDLAVTLICTPCTT

SEQ ID NO: 27526 - protein, 76 aa, Candida albicans
RDNQVKTLYFEIFFFRFFSHYRLLVDRVKLLLDLDLRWKNTININLIRISHLIQPKNNKQTDCSNLSSKVSSHKDK

SEQ ID NO: 27527 - protein, 72 aa, Candida albicans
PTTITENSVNLYCLCKRINKTTTHNTHAAKYSRIIFIILQIRSKNKYKKPKIRTPKLLFIVRSMALLLYIYN

SEQ ID NO: 27528 - protein, 188 aa, Candida albicans
TLISIAGEDPVSVKDLSLNEMGIQKLPDSFENLENLRSLSLFENQLRKVNSLKLPVSTLQTLNVCRCNLRLISPFLVSMLEEKNKNAELKVYASGNTNISVIDIRTALKSIKGLSLEVDDFDKTLTEISKHSSRLQCKYFVYDPYSKESKSSATEEVALDYDPDDLYDGSDSSLDEEDAGGDIKRRKM

SEQ ID NO: 27529 - protein, 67 aa, Candida albicans
HKSKKTVLTIGIVIVVVALVIFDDDFIKILTQKLDYQNKKKNIRCGPVKVDRKEWILAYLLASSVNS

SEQ ID NO: 27530 - protein, 60 aa, Candida albicans
PLIPLQLTQLSKKFILGVAVAVMALHMKINKLTLNPNPIPQLSTPLFCRLSPLPVDYICI

SEQ ID NO: 27531 - protein, 107 aa, Candida albicans
RLVLPAAGYKKHCLMDAAGTTNAEETSAKETTAAETSKAAESSAPAETSKAEETSKAAETTKAEESSVAQSSSSAADVASVSVEAANAGNMPAVAIGGVIAAVAALF

SEQ ID NO: 27532 - protein, 108 aa, Candida albicans
  UNSURE (3),(47),(49),(64),(65),(95): Identity of amino acid sequences at the above locations are unknown.
FKXNDGAGTETRIEGTLLVCALALAFKGVEDPGDNANAAPVPVPVVXKXQKVDGLLSFGWERYXXTYPKFLLPYNNNFRKALIRPNLKKTSRCPXYIGWWLNLSTHTC

SEQ ID NO: 27533 - protein, 81 aa, Candida albicans
VFNADPHILQKKTLAGKQISPIYVCLIFLAKIAKNKKKKFSFEIRSSTSFICDFRSFHTKIFLFFFTVVVFTTAAGRSATW

SEQ ID NO: 27534 - protein, 72 aa, Candida albicans
IGLICLPAKVFFCSIWGSALKTYIFNISMKIIYQSRTITRVNEKLSFAPPMFNREGGPIHQEMTNFKFVICR

SEQ ID NO: 27535 - protein, 249 aa, Candida albicans
KLLTMLSIVGLQLTAFNLGLAQITTAILYPLCFLIYNLINLINDLIFNSLITSHKMTWLQLIWIIIGLIGVLCGVVILSWDSAFNVNQNQRNLKNGHERGIGIGIDNDNYNDADLISMKFPYNSGTGNEHDGNADLNQSYLFDRVDEQTELLEGSGSRSGSTPLSSSSSYNSADNGSLKVYKPYSDEPTKDQTSVTIARQNEQEANIEALIQLNDEAAIDAEISMLSNNSNNHRMSFEQNQLLNLLDLN

SEQ ID NO: 27536 - protein, 61 aa, Candida albicans
REETVRERGGGRESQGDEMWYMTTQCLKLKCPGSEKMGESQRNSGDTILKRRPFKGTKLVV

SEQ ID NO: 27537 - protein, 163 aa, Candida albicans
SSIMIGIIIHHILEINIAESTNSETTTPTTTIDEYHLRLVYAVHIMMFQMNSSSTTNSTNPVFFDADNEFYSQTSDNTYDELFDNHSNNKQNHYTMIDLNQQYTVPDISSSPNVEDLTMLNATNAECSFIVEKIGTPTAIDTHDIMEDSEDELPIISTNSMST

SEQ ID NO: 27538 - protein, 134 aa, Candida albicans
SWIRQFAGEDASFPIVKYESHVNSLITNMKNKCINLNAMVYLLGYLDTKYRPYKAATKQELVESYNSMSPTPSSSSLSSFNEKGRVVLSPFKTHKSLDIKLIFYHDWYHNSPHFRNQYCGINKFRDYHPHHHNR

SEQ ID NO: 27539 - protein, 94 aa, Candida albicans
SATTLTSVSGAKPSVANDATNSVHTTDYTTATTGVQNGSSLSIPSDIPIEISDITPTDSSSSAVTISYENGSNKELIENIKYLTLVVFGLMMFM

SEQ ID NO: 27540 - protein, 69 aa, Candida albicans
FFLLKCIIRKIQYAMEVENGNILIGRQLVWDIPLISVSELTLGISNSGNNCKICRAINTSCTTCRRLFY

SEQ ID NO: 27541 - protein, 133 aa, Candida albicans
GNNSSGTDNSSTTSSSSSTASISVLLGHLKLGKDNNGNPTAASTSNLNGNHDKHVSSRSHKISHQHLVHRSHHHHTNHHIKRTGTFHGVSVNDPESSNSSDVGSDYRSLNASPVSINNESGGTSSLKFWSRKK

SEQ ID NO: 27542 - protein, 250 aa, Candida albicans
GGSGQPRGESTTKIADQTLNSIIRSYSQLNQKKPINIEDFKLNERQKILLGYYIRNDYTVGTKFVGINPVFDKDTKIKIVKLFNNSDIKLPIIENKTKPIESPYQLTTPVINNNLINRILLLDTVWSKLGRSIQDNQYVGGMKYSHFINLAILKHLSKQFRSQQDILREILTSDSFKIYLQDYLEIDNFNKFFGCMSETQKLQWTNELMLTLIKMIKPLDLVSLESFPQEFKLQTLNYSIANTTVSNHET

SEQ ID NO: 27543 - protein, 65 aa, Candida albicans
CKCGSFQRRWVKKTLGELSNWDSQSYSPGFDDDELAELQSTLNLRKIKLSSNLFSSINDTLIASL

SEQ ID NO: 27544 - protein, 313 aa, Candida albicans
SFEPLVVKNSNNTNLRPSIHSAPIRSRAPTRPTPRAIPPTRIVPQIAIPPQPQYYYVSTPYQQYYPAQIVGATPTQPVFQPLPRSQLRQVNPRVRMIPLSSTTTHFGRRTLQQGPSQLPPGAILQQQQQQQSLPLQQQPQQQPQSQQAISLQSTAPKPKPNAVTDVFRGDFHKAAPLHSQPLSAQREYFENSVHDEPPQKSQVISIAESQEISGSITINGSNVFNFKIFNKNEEEKSNDNEGTSKDNTSGKKQEGTLEKEEEPTDEEGKGESNVTEEKTHKSTKLEDLEEDNKKKFLKICETCWDQVFNKRDD

SEQ ID NO: 27545 - protein, 259 aa, Candida albicans
  UNSURE (246),(248): Identity of amino acid sequences at the above locations are unknown.
CFTTILSHTYSHVIVLTMYINQYLNIDKLIFYLSCTIIGWLLFWYIIFKLTGFHLLTITINNGILFNGISFHTKRYLISVGSLRFRLWGNSKMTIIDDLTIKLLPNVKNNQKQNTQEKRNDYSFKDPTAPVVNIFPQNRIGKSVVSRLIRHLPKMNLELRQTAIITPSENKTIIEYLKFTTSSKYSKRSNEKITFKAGLYINNVLHHLKTKGDVIKPFQIGGASFEAKFLINFETGVLDDLRTRVXSXRRARTAHILPH

SEQ ID NO: 27546 - protein, 67 aa, Candida albicans
FEFHFLLLFLSFFLSNKIFHFLIIFNEYIYYILRTVQYVIRRYWKFKFISSRVCWSTATQQNTTFHR

SEQ ID NO: 27547 - protein, 76 aa, Candida albicans
KNIEKGEWSSGMIPRLGLFPNIKIRGGPGFNSPFAPTFFFAFSYYFFLVESLLKPQCPRELNNVYYLIELNYKYFY

SEQ ID NO: 27548 - protein, 128 aa, Candida albicans
SPSLPLNVFIISRSGSSGTNLSFCDVLLVLCNPILLDLTNLEFVLAVLDEGDNVGCFSDTNDGVGVIDEVEAVVDDDDDGLASSCDDDSCCVDEGNTIGFSGISELSSGVLSVLLLVILSIYIYVSLY

SEQ ID NO: 27549 - protein, 128 aa, Candida albicans
IMSILRGHKLPKSSKILLGLLTGISILLLVLKYQQFQSLQSSLEEIKLHDVKISFIQLIPRSTIYNPWVLILSIFAEISIISFIFSFVVLYIGSKFAERFWGNYLEVIKFVIIVGSITNLITVIIAII

SEQ ID NO: 27550 - protein, 83 aa, Candida albicans
YFNTNNNIDIPVNNPSKILDDFGNLCPLKILIIYNVSTLFPKNKKKKNLQLIEKLVDLVCFIEIELVSSVIVVVIVYSLYGLV

SEQ ID NO: 27551 - protein, 113 aa, Candida albicans
  UNSURE (104): Identity of amino acid sequences at the above locations are unknown.
PNKHYFYIFKYSITVVFYTFYSFPFFPPQTPSLDIYFYKLIMGNNTSTGNFHSSGLNKRQGNSSDSIRKSSASVNYNNSVDSSSDNRVRKSTANKNANSLDEEXSDLILHQVV

SEQ ID NO: 27552 - protein, 63 aa, Candida albicans
GFSITKPNQTKQSKNGEREKDNCPIEKEKEKEKEREGNYGANKNIERNNSGQLKFSYTFCQTK

SEQ ID NO: 27553 - protein, 79 aa, Candida albicans
ILKDVKIVFVWLKQFMGSFTSIQFSFFFFFFFLSLILRIFNYQTKPNQTKQKWRERKRQLSDRERERERERERGKLRCK

SEQ ID NO: 27554 - protein, 157 aa, Candida albicans
PVVKTGEVMAIKSPLLSKAKYKLPAICPGIELECKDLFISRDCLYLIMKSAINLKLYEYVDLLYDKIVLDSIDPHRIQLNYEEKRLVEGSIFTPELFLIMLEACKKSKDLGRVLWLMPFLDEYVGKNSVPVTLKNSILEVLKTFNLEGKLVSYQKIM

SEQ ID NO: 27555 - protein, 82 aa, Candida albicans
IGSYFPRYIYQRQFLHILGYLFEQALTIMKAAVVPISIKDNYLTEIKDIPKPEIKDDQILIKAKACAINRTDWFSSREPAPR

SEQ ID NO: 27556 - protein, 61 aa, Candida albicans
LRTFYMRLHISADLTLSKSSPSATTYVHKIKLLLHNKQRQISYLIENGLNVSIYIIQAYSS

SEQ ID NO: 27557 - protein, 78 aa, Candida albicans
  UNSURE (3),(26): Identity of amino acid sequences at the above locations are unknown.
QLXNKKKKHYPTIIINFNQFLWKSSXFFYIKLISKFHHPSPSSLPPFIPPSSPFLNLTLSYKKIWCVLMVIWNDKLIN

SEQ ID NO: 27558 - protein, 117 aa, Candida albicans
CYSMGKLQTESISTSHETSSYDLSHDITLDQESESSNSSNDDDEGEDIGFIETKDILRNLSLYNDYHNNNNNHNNNSADRTGASTTTNTGTNSFNKPNGFHQRTTSVSNKTIDHINI

SEQ ID NO: 27559 - protein, 121 aa, Candida albicans
KSHKKSSSDVSNLQIQYPPQKYKFTPTTITTTSGGTSSGTTSNTSRRDDNSKAQKKSNVENTSNGNELQLNGNTNSRSGIHSGITTFTPTPTLKKKPVIRGRKVSELAKLFEERSGGIEIL

SEQ ID NO: 27560 - protein, 64 aa, Candida albicans
VDEIGFGFDFDFDLDFETDLEVVEVCSIFENNLSTVFSAWYLDALELNDITMVSRFNRLIDLLT

SEQ ID NO: 27561 - protein, 249 aa, Candida albicans
RGKKKKISKPHLGIFSRSSYVSKSINLLNLLTIVMSFNSNASKYQAENTVDKLFSNILHTSTTSKSVSKSKSKSKSKPKPISSTQLLVNQLQSTNTTANNNNTKRKKHNNNKRINKTLLEEKKFSKFIKYNHIKQKSNKSELDEKYLNKLVRKNINSLNKINKIDDLLIDEELNQIKQELLEENEFVGMGGGQLKGGKRLRKKLLNNTKQVIDEFDGFGEISSSNNNNKKKNSSYPGLTPGLAPVEYEA

SEQ ID NO: 27562 - protein, 172 aa, Candida albicans
RCPSWCDRILFLSTYETIGNDDLGLQLLRAKGKDSKQKNEGLPVVGKYDCIDELLLSDHRPVFAHIDIPFAPPKLIISPMSGCLEIVSTGLTLDESFSGFEQLQGIDNNTHIESGPTAIYLKPTKLDLLIHTLVTPFMDTTIGYGLWFGTTSEGRLVLLIFALLCFSLWYLF

SEQ ID NO: 27563 - protein, 68 aa, Candida albicans
RLVDGECDICIMVCAHTHPPISGIFFFLLRRDCTPKVYHYLLTTNYMNGEEQVDNYDEFEIYCLLATE

SEQ ID NO: 27564 - protein, 223 aa, Candida albicans
EDSEFKLPGQEPSGFSSLPKSPTQYQKVNETMERLNYTARPQSDLYPGQYKVLRRVDTNKRLDIGNRYLGTFIIGSVIVYGVFFHRWNDGRENVFSDFYRAQLKLKEKLMGGLNEQEYDDLYHPRDSGIVVRNVRDAQYIPEDIRKTSETNYNLNRPSERHVLEAQRIQQEQEEKMLKELDYHKKFAQSVLKEEEIDVKELHNQQEATNITADKPKKKWFGIF

SEQ ID NO: 27565 - protein, 102 aa, Candida albicans
ARGRATYEVKMLELKRILIELNKKSPSLFTAISNNNNNNNNNGHNNNPALNLFKSLHYDSRESILRLLNPQPDKRLTPNQLLNTNWLSQVYADPKDLIKLLK

SEQ ID NO: 27566 - protein, 152 aa, Candida albicans
VLCFFLNLNSFSYYNLLNYSSLKSIMKPPQRKEYNIKNNNHNHNQSKSNTNGNGNGNGNGNGNANSNTTTIMNNNRKSSMKKYRSIATQTLPNLSTSSQLSNYNSQYNDISEYKYSNYSYYYNSLDELFLQFEYEDPELEYIDQFIKEKLSR

SEQ ID NO: 27567 - protein, 67 aa, Candida albicans
TRTSHQQQRTHRHFVSIQDRISGISEFVATFNLSLCVYLYFHLVFDNITKLRQFRNLLWLIVLVQAT

SEQ ID NO: 27568 - protein, 86 aa, Candida albicans
MLYIIFGILIVRVTDQTNPHFLKERKTKETRNNNNIFEILMTRKDNNIIIIKTVSQIVVLLTRKLVGSITQKLQFGLLHQALEGAT

SEQ ID NO: 27569 - protein, 63 aa, Candida albicans
HNSNILMFIYLAWHKVSLTLSYQYNQAQGSENNFKTLYFVQASGWSIHQFKHPILLPYNNCFT

SEQ ID NO: 27570 - protein, 81 aa, Candida albicans
NTLCYTKKIGLYLETIQTKTKRKRRKTDRHHVEQWGTIEENKIKEKPRNTKDKYKKIIGGHTLCCEVIEYTQLFFLISISK

SEQ ID NO: 27571 - protein, 119 aa, Candida albicans
ARIRLAPWWTILAVQYPISKVQKIHLSRLEALDVYNASRFVGNTSPFFKLYYNSYVDTYKQVLRMKQRANITWFEAAYSGFVRNALTTIPATSIALLVFEIMRTKLSDNFEDYNDVLEA

SEQ ID NO: 27572 - protein, 69 aa, Candida albicans
CVLRKRGSFQRGGEDYFRVTTLNSNSHDFDCYTNLQNSIHYFFPHVEDLKSSSIYSQHQLKTVLSNKFR

SEQ ID NO: 27573 - protein, 66 aa, Candida albicans
AFFCYYYCWSNTKRIVKINIDSNSHINLKVDETNRHCVTRLIVLDQIRKVNKSQQSCLSLTLVQCL

SEQ ID NO: 27574 - protein, 116 aa, Candida albicans
ENIHIHTHTHIHTRIYLFIFPYLLAMTDTSDLKPEHTEKATGLSTSKEVPESTLTQRKQPSTPATQTSKRPTPAKKKRAFINVAPLNTPLSHRLETSGAVWLCYCHRRMERQVLPL

SEQ ID NO: 27575 - protein, 192 aa, Candida albicans
CAYVDYTEDQLNEFKKAKILQEQQEQQQEQQQEQEQQSDQETNNQQLLKTNKKVLKPKKSRTVPSFSFGRASSNPSVPSVLATGTSTSFTNQELLQQQRQHHSVPNIGTNFNTMALSSSSSSSQASSVVADDEVVEPLPVPRSNNESRVNLLPEGNDFQILFPAYPDTADFPPTITPSRLHHGRLEGPTLGL

SEQ ID NO: 27576 - protein, 122 aa, Candida albicans
LTVATHNKNESSTFETESTGFAIENGYLSYKNSTHFLACPTSSSLTTTNDTIVGGNGNNFTNSSINGDAGFEIYANPKGKTTCPKGIEGYDIKLLTELIVTYSYSEKFNSNGFFKRQLSKDL

SEQ ID NO: 27577 - protein, 62 aa, Candida albicans
QDIGHLRKFEVIRYLHGFDIEYNNHNVLLEIHLRNLLKDRLIIEMNYLNGGVKRQSVPKQKN

SEQ ID NO: 27578 - protein, 65 aa, Candida albicans
QESDTKHCFGNIFKGWDILFSFQQFYFFLFRNNHIIILHCPNSNTYTYIELHNASSPRGWKDPRY

SEQ ID NO: 27579 - protein, 79 aa, Candida albicans
SCYFCYINFHFRKFTEFLARLVVPNRINLINQNSLLNSLSPSPFFLAVAFFRGYFLRFCFVFLYNNYGCCYQLITTVKS

SEQ ID NO: 27580 - protein, 78 aa, Candida albicans
SRKKKTIQPTTHKLTRQKKNSLISYKTFFIVKQHITSHHTLYIMSFAESFWTPDYELGFQQLFLQLNQGILETNDFVF

SEQ ID NO: 27581 - protein, 65 aa, Candida albicans
EKQKKRLKLLDVKKKKIQLVVLNYNLLIGRSEKKISCVIKSFFFSVSVSVSSFQVNNICSVDNQP

SEQ ID NO: 27582 - protein, 142 aa, Candida albicans
NDQGSNQGKLSITIAQHKHNHYLFAQSNSLYLSMGKDSSISISFPNPVFTINQFSRSLNYQETNIYVNNLPIVFNNDDCTWESFWGQFGIIKSAKIIKPQFYHEYEDDHKSGKIGFVFYKTFKMAIRAILMTNNKVVNAGHC

SEQ ID NO: 27583 - protein, 60 aa, Candida albicans
AFNVINAIPELGIAYPTINSTRTFNPNENPVTDAIDVKGIKKMKLMAIVKKIPHIGVSTG

SEQ ID NO: 27584 - protein, 93 aa, Candida albicans
CIERRKANQIKKEIFLSCLFVYIFFSFGCVVSVKAYTTTKLNYTNYEHTQKKKTQIRRVMTLPKVLRSRTFDPIFPPPSSPRALGRTANCVTA

SEQ ID NO: 27585 - protein, 127 aa, Candida albicans
NNLAAFDSYVMSYPNSLGSPATVTSTSVPTAKQSSISVADRERPFTEAESNRLVKIDKDEELIGDGCLTSDNNNNNNNSNSNGNGNGNGYSAANSSGASTSRRAIFNTLGGVRSLLPREAGGTAMEF

SEQ ID NO: 27586 - protein, 231 aa, Candida albicans
  UNSURE (223): Identity of amino acid sequences at the above locations are unknown.
WTFFCSEKSNDVFDSTYRNCHLIYTAHSATVHQLFNIIEFNLIHELQDTFSIKEQPLTWLFKQSTARRSLAMDQVLENSSLLLLSLLKQFGQPRSKWFDRLAEYVFNGLTSKTDVIPATCYEREKDLIKKDEGLSHQRKKKKYTFYNDNMDSMKLRFKILNIVHYWSLFFDKTTPDGINQPMSQSINSIESTKLIEEIARKFMYMEYDYWVEFYYSLLVDSKXSLEYREVF

SEQ ID NO: 27587 - protein, 140 aa, Candida albicans
RSPKDILSNRHHCPIIMSIFTKQFPNLKQLQKNITQELLKYENSTARSLSKAELEKTRTYYNYLKKVKLSKGEILAIKDIDTKLADLSKDKFQHQAELQNKNSLNGITENITNEKLPHEYKLNNLNNVFTIGNKPDARYR

SEQ ID NO: 27588 - protein, 70 aa, Candida albicans
NEIQNNEYITRLGKMQIMVLFLEKCQIISVGLIFKLMGTTDPELSFNGNRAINKLKGILLFRTVVVLISN

SEQ ID NO: 27589 - protein, 210 aa, Candida albicans
  UNSURE (181),(185): Identity of amino acid sequences at the above locations are unknown.
GSHGVAKILTELWTRSSNSFQSNLFSNRFEESKRFHKYETVDSENLWDDELLQNSKSQRNPSKVTCMTISFQFNSYEPEPFKYFENKISVSFDSISNLNVKILDKELLEKCLSGKLETSLFKLLRRNQTQGFSDRPHLNKGDIHNINYINGIMKTFFKMREHSGAAVIKPQQESLVSSSSXFLSXIGADKPRLYSHSDFILRELQIFTGA

SEQ ID NO: 27590 - protein, 110 aa, Candida albicans
QIQTRLMTSGSISVSLSSGKDLKYHQPHNSINSTASLRSSSIGSSFFTPNNTHGAGSNSSSSNDPSFLNGENTSANCTNSTESYDNELIEPTKDIDIVGAISTLHLHDDD

SEQ ID NO: 27591 - protein, 169 aa, Candida albicans
NRIWKLKKTWNITQLAPPPPIRLNVSENGNHPNDQNVFVKPFELPESQEDASKKQTTNGLNLPLLGKILDSEGRTNDNDQNISASKPQFYDGAIPFVPVNQNVTGNGNSQIPPPLGNIPPPMSNMPPPLPPHSMGLPSFSPFPHPSFYQGYIPSPPAHTPTPGDYQSFD

SEQ ID NO: 27592 - protein, 163 aa, Candida albicans
AHDEFKQLFLKGFSITTTTTNEESVVGFNLREKFNSKLLDINSEFTSLEESGLIEFINSLASSSSSSSSPSSSSSPTSTTIMFRLAKLQQEFTQLVLNIIDELKYSKDFEKLNRLILAIMNNIEIVNIILFNSNLSLLYKLIDIIDSSNFTTDDNGNGNDNNN

SEQ ID NO: 27593 - protein, 63 aa, Candida albicans
FNIDRLVSLKGIVYPPVVLIYNVESRREWGGGRKEVLVVDGGWKNNEFQRLKGKNGKKKKKKI

SEQ ID NO: 27594 - protein, 86 aa, Candida albicans
RNQPVYIKLLLQLQPSFHHIHFHPLSISPFFFCPTVAQFDIYIYIYTLYQPSSIQHTIVIKVISPEPEITLHLTPAPTSFNSHRYV

SEQ ID NO: 27595 - protein, 230 aa, Candida albicans
NTIGNKYIDNDGLIDIYNWLEYNQYHDNLSNLNNGGVLSSNLSVASSPPQEGENQDGNASDGTTDTQFGFDVSLGLRVLNPVNLTNNLVISPINYTVSTVMEGTQVSNWLAMPQFIKKLTVGDDNETAELPPDQTADINENRSEEDEDDLSGEFIIGLQSDGSILRQVVYLKTTDSTYQEHQLVTYHKDDIYVTLVCESSDPKLDLSGFYKSLETSLLNSSPRSGRSSVT

SEQ ID NO: 27596 - protein, 64 aa, Candida albicans
NASADPSRGVCEDKGGEQIIKAAVVVTTRQDIGVKNNDAFLCNVIAPATVYYISIVNWNFQITV

SEQ ID NO: 27597 - protein, 146 aa, Candida albicans
TVSLPRGEDLKENIISTEVETEQKYYDYLSILLKKYQLYHVDAKSFTKRGNLGFFPTNDIDKSIRVLYTDALRALIDYKGEQLKIGHIEPLINEWSLDNEMRLELEDWVANDRIKYYKEKLETRREQFMNNLRSDDNDNDSLLDLM

SEQ ID NO: 27598 - protein, 60 aa, Candida albicans
RSYETKVEVAINSPAYDEVTEKNIMTIIIASPVLPIKYVAAAAAGSPSPTSKSVNFGKSG

SEQ ID NO: 27599 - protein, 67 aa, Candida albicans
STADPPRRIHELTIALHTNPHQRKAKWPGTPNLKYPISGNVVTKFAFFLILLEITEKIETWRSPPIA

SEQ ID NO: 27600 - protein, 64 aa, Candida albicans
GLENFIVFKDKAVEYQLYLLPHYKEKRSFCQLRTSTETQILILRNKWYVFNIYLIKILSFYRWM

SEQ ID NO: 27601 - protein, 78 aa, Candida albicans
FNYSKHLFKIDLRTILYTSIEGNFKSFLITAWNNGYIMYKSSGVEYVSKVDTIFDTLDAKKSCSKVSTVIFSCVVVCG

SEQ ID NO: 27602 - protein, 201 aa, Candida albicans
PIKKTYNILGTALFKRYLTCLDIPTDNILQYNEIHGKSQEFAQICLELFTSISSQLDLQALLADLLKLLYNYPKLITPQIIEPFVNVIQMAKISDKDYYLLILELSKYFTQFDLLSKEQTYQVIESAYTKYKLFGGKGKGKGKINPFIGYKKVIVSLVNNDFIMEDSQLLDEILLDYKQSLQFKYRPCLRPRELAGSALKY

SEQ ID NO: 27603 - protein, 108 aa, Candida albicans
  UNSURE (4),(9): Identity of amino acid sequences at the above locations are unknown.
FLFXRSCLXYGHIPGQDTIPRTPMDVVIIIIRRCPHHHGFHLKLLLIGFTAKFLISKAMVDTQINLDGIKKFSSKLFSSFAYKPFNYSIASFTRLATVRKNTTISNEK

SEQ ID NO: 27604 - protein, 104 aa, Candida albicans
RTFATLAQQQQLDHERQVVAEQQKQPPSQPHTTTQENITVDTFEQDFLASKVSKIVSTFETYSTPDDLYIIYPLFQAVIRNDLKLPSIDVYNIVLKSILNRCFE

SEQ ID NO: 27605 - protein, 140 aa, Candida albicans
ILNMKFSTVFTAIFALGTAVLAQQVVTPASDPLALELSQRNLDKLYELQERDLFSIVEGLFSSINYTSILDSIDYESIAGWTNNLLVENNNIEYLDNILNFLGDTDLVPFAVSYLLSNNETRNIVGEVVIEAWTTYFFTT

SEQ ID NO: 27606 - protein, 66 aa, Candida albicans
YLFLYQMFSATVRSALRSRLSAQVPRASNTLRAVTISKPLTSQIRSYSSNHHEETFEEFTARYVIE

SEQ ID NO: 27607 - protein, 73 aa, Candida albicans
LESRNQLYIYIYIYIVSCQLVLILIHYQFKKSILIIITLPSAFFFCLIYFSTILNYYISINRSISDVNDIKRY

SEQ ID NO: 27608 - protein, 151 aa, Candida albicans
LWYHPRPPVKNKKNMYDRISLTKSTIGVIKKLEEAIKLIESNNNNNNTATGSGSGSGGGVRDSTNINGLLNEAKSLLYKPTRRALEQIKNGDNTNNTASNNSTTGDDVNDGGSKINSTTTGGSTTIDVELQDDSFKPLSLKTPQTFKIWAP

SEQ ID NO: 27609 - protein, 264 aa, Candida albicans
FRSRFLLINSHNNKEHALKIAKARRGLKSKPKNESNDNAIASSSESESNSESDNEDDDDDVVSLKKLKPRKKSFLKYGRRRSDAVLPDINFKFEFDTGENDELEAGNQETHIKEPAEEDIGEEVDYSPENPVDSNNVPSLEFEFDHHLIEVPKINEEELNSDEDYEIDDNELLATLQAENDAEEFLPPITKGNSQPQRNDSLISSTIEEEENDNDNEEASKGGDGDDDDDDDDDENDPFLKEEEKYLVNEFETFFHQAARRTHA

SEQ ID NO: 27610 - protein, 181 aa, Candida albicans
QVINHYYCFLNSMQSLHFILIVLFFISCISNALTIQKDSLRFTRTSLSSTFDPHDAFETAVNSTWSTFWNNINQGFSQSDPSCLESQTFQYSVVWDVAVAGLAIVESRDISKTNDVATSLYKYQNSHGWFAATPGNTHSYVDDNCQVLWVFLQAYELTHNEKYLTTANKLMELIQGQWSSP

SEQ ID NO: 27611 - protein, 186 aa, Candida albicans
CVKTMKLPSTNYVPGYAVRKSPTNRATNVVRMLEGKSHLLTYADIPTKLVFLNKQGGIYVTEVSTKQRITESGLFDGFVKSHYADSRIPETIILDPIKEFESLLKLKEPQKWNEVYDSRNFSYSITLTDYDIPEKDFNYSESEFLDDMTKFGDRLDSLHDLTTNELRFDKQEIANLRLNRNEMRYY

SEQ ID NO: 27612 - protein, 67 aa, Candida albicans
QQFFPMIGICATLHDMCFSAFELFIQNSRHMQIVHKLRVWYKRNKKCQIFYIVIYFNYGKLNVYSVL

SEQ ID NO: 27613 - protein, 101 aa, Candida albicans
TQMKVNHNHISNTGVYDSEDILEAQDEISIDNNKNQENIWNKKSIFHTWLLLCYSTGPVASMSLTYIPASIQSIAKNVGKTKMNQPCGHTGEMIAMSSLDL

SEQ ID NO: 27614 - protein, 74 aa, Candida albicans
EVQFFKSAPFLSRVTTTTTTTTYTNGNDFLMELRFAWSQLVAGEIQKKTNFQQQTSIASGIPPPLHFISNQLII

SEQ ID NO: 27615 - protein, 221 aa, Candida albicans
GLGFQRVGQTSSVSGGTIAGAVVGSVAGTALVAGLVFLFCWYTRKKQDEYDDDVDDQFTLSGPKQEMEQHPYSTIGGGGAGGGGGAAMLDPNPFLIAGGYNNFDTSQQQTPRQQIISNGTVTGSGGYGHNHKISSSGTSGDGNHSFGSQTDTEFAFYDYSNSNNNNNTTTSPNINNNNNNTNNGVLHTNSPNPEFGRRRLSNGSLPDMIARNPGSLKVVNN

SEQ ID NO: 27616 - protein, 65 aa, Candida albicans
LFGCKTIFFFSLPSYSTTTKNIKMRGNNRHYKFINVLIQEHDYCHLVILDDNSMILEDNHQLHFI

SEQ ID NO: 27617 - protein, 141 aa, Candida albicans
LINKSLLFNYQSNMAENAHSISTATDSSAYSSGKSFTKHGHRNKRLKSTNSSRYMVQETPVPVQTNSEISQNLKTSTLTTTTTNSNNDNNNGNTNEIAILNSSPLKQLSPSQPLPEVLPTEPDENQPACVHPQGLEGHASP

SEQ ID NO: 27618 - protein, 65 aa, Candida albicans
STAFIFTIYYYSMRFPLSTLLVGATLLTFTSCVTDFDQKVLQLDKLFSEQGPTINVLQAYEEIIR

SEQ ID NO: 27619 - protein, 187 aa, Candida albicans
DPLLLSSKKFHDLLRLVPSEIHVILYLYMVQLNIQPAIRRHMDGLIKKLINESAKARFVAQTGYFSPKWHELTKTQFNETKRLQMVNFFAITDFERFAQYSIKHNQPAMALYYLNCMLTKFERKCLHGAKVVDNTTTEQDIQMLLKTVLNLVMKFKGGSHGIDVLKYMNSVNLRVTFDLYLSLLQNL

SEQ ID NO: 27620 - protein, 62 aa, Candida albicans
FKPKQNLTNSKNKGKFITKYYFCIESPNFNSSWFHKRYCNTLILTFFFKILCWFYSIPFLKP

SEQ ID NO: 27621 - protein, 77 aa, Candida albicans
LSIILHTHTHTPYTHNSFDSNASNTLNTEMQDLDTPKEVSQAIRQANTDEEANIENGNELQQQQREQQQQEPENHTN

SEQ ID NO: 27622 - protein, 74 aa, Candida albicans
  UNSURE (6),(7),(35),(57),(58),(59),(65): Identity of amino acid sequences at the above locations are unknown.
ITHLSXXFFFPGCFRFLVNKTKEIMDKCKKKKKQXPPPPPLGWGGGGVSVGSASGFXXXPPRAEXKVHKKKHDF

SEQ ID NO: 27623 - protein, 107 aa, Candida albicans
HNSTSTSITTTNSNNEMFHLNKQINISDTNCEEISIPSKKRYSTVSIKQQQYPQQSQFQTPKNYCPSPLQLTRSSSIRSNGSINTILQQQLQQQSPMMVLQLQLQLQ

SEQ ID NO: 27624 - protein, 132 aa, Candida albicans
QQLQLQQQQLVPNTPPSQYIININRTPNNLTPSQRLSLRKSNINNSISQYKSDQTNIFKYKQNPSPPPPPAAVLSEQQQQRNSPIIDDADELIDDNVIFNVPFSQSILSLNQHEKFYLIISLLHHEKWKTRV

SEQ ID NO: 27625 - protein, 67 aa, Candida albicans
VHYSTNTIFKQYHFNQLAQSIISIKSINQSKQIECDLLWGKFYFDFTHIFVMCFGFKLNRKLTERQN

SEQ ID NO: 27626 - protein, 86 aa, Candida albicans
VLLIKVELNKEAGTTSGNEYRLSISYGDSSTNNLIIKYHEGDWKIVSLQGYKDNNNNNKLISKINSLGNQKDFFKAIAQFIVELTK

SEQ ID NO: 27627 - protein, 355 aa, Candida albicans
  UNSURE (3): Identity of amino acid sequences at the above locations are unknown.
FLXNQQEENGFQTPELVALRNSNKYVFVINWLYNYRGYLKLQSELFDIDLFELELLGFFNAFDLSSLFINKLKLALITSVQNSKLVELEDFEFVFRAHFGDDSPLGIQTDNEQDSVKFDLLNITEKFDILYILINYISKYSKFRDWTEKQGLTTRIDPIFKLSLAEYFSLFDDNRLYKRTITYYPLTIPKKRKLSPESPQDYFDSKVFDVKDVKFELVYKNIYEFNEYLSKIKKSLAHKLLYTKLAGKSSTIIDTIFDNEVKKRRYLINKRKEIQMVNLLAVRKRSSRLEAKERQRQEELERQREEESKQAAERRFERRMKLKNTENMDTGKLSRDQRMQLRQLNYEPTPEPDKA

SEQ ID NO: 27628 - protein, 74 aa, Candida albicans
  UNSURE (9),(16): Identity of amino acid sequences at the above locations are unknown.
NPFSSCWFXKNYGVCXDKDAIWSRLPIFKIWNRWSPSNGTGVEEVTPTYQVVWYLMCKKRSLKPIVEQKKWVPW

SEQ ID NO: 27629 - protein, 66 aa, Candida albicans
KGRHPPKNSTVVEHIQANYTKFDPPHNIITTQIAKNTNIITGLINSTTDSLLLIKPETLDPPTPAL

SEQ ID NO: 27630 - protein, 92 aa, Candida albicans
QQSNWTKVEIQSSSEDSQKVLYKWARSSEHDINQNTDLDEYDDWIDKAIKDISISYQENQVIKAQWSKHARKVEKIKHILEAQDEDGDIEMI

SEQ ID NO: 27631 - protein, 67 aa, Candida albicans
QISKKDYSVKSSSDIFQLSSRNQEQIMSLYSNIRTFLTRSIVLNRIKPLKFEDLTKIKLREPVVPRV

SEQ ID NO: 27632 - protein, 85 aa, Candida albicans
WGEGVWIMYPCCIVSSTKFIITCSSYHFSFLDFFSLAAHFFLIKYDLAQAGRRIINQSDKPHTTKFLSNWNISLPFFSIPNSFRL

SEQ ID NO: 27633 - protein, 61 aa, Candida albicans
NIFNWIEVFFSFFDSLLKEKVRITFLNIETHPSFLLVERVQVNMVALDFFCSLSHVFLLRI

SEQ ID NO: 27634 - protein, 66 aa, Candida albicans
QLVMSAYKQAGVSLNKALAIAAQTLRNSLKPEFKAAAEKRGFVEAKVITFKDGKQGEPVALKPTDN

SEQ ID NO: 27635 - protein, 163 aa, Candida albicans
FDLIPVGLILLLLFMFSTRVTFRWSLSIRPNSLFSRFNSTTAKQYVRQKPKMMDLIRTPTTKSLILTLITSSMIIELMNSKKNFETLINSYNLKFEILLEIIDKLNNNEKFDITKELQLANSFTENKYSSKTDIQMDEQLEQFLKDITQDEGENNQLQLIEVD

SEQ ID NO: 27636 - protein, 60 aa, Candida albicans
TLKLASLKFWKIFDFFSKMQNEPNPHTKKTLTNSKFRFRLLGHELIENDPLISNIFTIST

SEQ ID NO: 27637 - protein, 253 aa, Candida albicans
  UNSURE (204): Identity of amino acid sequences at the above locations are unknown.
AWSNRKNWALFINYNQRLNQGFDSHVYFANQLKNLKILKCSILNDNDDDCEWEFQMDDYEDAGVLHGGTELININQLLHQYDYPELNSIKDLIPNGREYWVGFARASLKNCGCGSRMYRPNLIVLMKDGKNYKFAYVSSFVGLGIEILPWYLDKGLCEHYNLIIPNGISSWTIEKDLHQKEKDKQVMDYMAFTISRRDATVDVXYVKGLLKALFTDSSSSKHLLAVEQTGFKLVTNVDCALKNSEKFCKIYGE

SEQ ID NO: 27638 - protein, 67 aa, Candida albicans
RTKNTIDEEGFNGVIEAFEKFKSKTSARLNSSKTTDPNVNDVVNPRTVVVCNILFIEIASDSKTGEL

SEQ ID NO: 27639 - protein, 129 aa, Candida albicans
FFKKKLTYFRTTNYQIYLNSYSSPVFESLAISMNNILQTTTVRGLTTSLTLGSVVLELFNLAEVLDLNFSNASITPLNPSSSIVFFVRQDRKDKNRTVKVFNGNGDQVYSFERLSTFNPIWRMLNYPQP

SEQ ID NO: 27640 - protein, 82 aa, Candida albicans
EMLAPRQDYLPSPNRTSINYEDLDLNTRLEYAQFDSISQVLPFTTKTILVLWKKSPKTILIHLFKRSTCYRFNKKQCCRTNN

SEQ ID NO: 27641 - protein, 154 aa, Candida albicans
KTTASANKLQPRLTHLNTAPQLTQIHSDTELITDKDRTGHHITNNNTNNPTLMNNSSTINTSIGDLSNKSKRQQANELFNALRDKQSDNYRFVEFTNNQPTPDIPSKQYTKQVSFDDINIQYDMDDIPDPDDDFGWELYKLKNRDRLSGTNNPW

SEQ ID NO: 27642 - protein, 63 aa, Candida albicans
VKGDNLDEAPAFPKGDGVRKVSRPRPKPRPRPILEPTRYPGNELLFAPPPPLPLPLPGIICSR

SEQ ID NO: 27643 - protein, 61 aa, Candida albicans
TCPLTLLLIKNISNLINMSLNGKTDLEKSGARVSVTASTVSENRTTGFELYEKAQELSFEE

SEQ ID NO: 27644 - protein, 89 aa, Candida albicans
HEFLIYLVLYRFLFYSMSINININMYISYCVKKRLRKWLRKINSREIWSYSLSSIRLYICVVNDPHLKIIVAIVIKISDKKKKSLNVDR

SEQ ID NO: 27645 - protein, 182 aa, Candida albicans
  UNSURE (163): Identity of amino acid sequences at the above locations are unknown.
MSKQDPPPDYTNRTSDNYNPDTTDNHNIPPPFTTHPIEVHPPPFSSSTSPNIRVPAYFQNQTTSGWTIVINNRFWTDGFRIFVSEDASNKFDAFKKSKNPEIIQLQEQGIGVPLFKAVTSYIPLATKFITFRRYVPTNLHPFDIDKDYYDYCIVKRKLHVGYXSYIFEFIPDVHHAAGDPQS

SEQ ID NO: 27646 - protein, 68 aa, Candida albicans
  UNSURE (31): Identity of amino acid sequences at the above locations are unknown.
INANLFENTLLLPDFKDNFIDKVFINLLITXQLSSNYVSDKDGECYDLIFSFDPNLDVQTPSIEDLAT

SEQ ID NO: 27647 - protein, 240 aa, Candida albicans
YFHLIQIWMFKLLVLRILQRENGNQCPILVPIPVFTLEHIALQLPQPQQVDLMESIDAALNKWRVKCINTLVVNFFNLDEMSNDFFTENYGLNMKEFWNMMHNNRQGLNKLLDNYNGQLVLLFSEEKLIKKLNSFYNRGGNGGFDQVRDANCQLFKSKLAEAVYQKFMDLDEGVDEIELNLNGKREYETARELQYDDDEDYIANNYKKFRRLNDDANMSERKLARVDTDLLLHHGLEDPL

SEQ ID NO: 27648 - protein, 112 aa, Candida albicans
  UNSURE (104),(111): Identity of amino acid sequences at the above locations are unknown.
VNSILSLFSPKPPFMTNEINSATVTQDEVIKWSREAQSTLEKTQKICTDAQSLMQKTAQELTILIPDKLQAIEFLFKSYREQYDSILKQIETTKIYLHTNIAYXNRHAGRXQ

SEQ ID NO: 27649 - protein, 68 aa, Candida albicans
SNPHFTSLTHQQQQSQLNLLLRAGGKKKLTEKKQILIQNSEKVYTAFNISTNRYEFIFSTQIFSLSCN

SEQ ID NO: 27650 - protein, 71 aa, Candida albicans
SMKEYSFSKTMRQLIPLMILHNVQFGTDKNKYSLGHGPPIFIIDEKIDRTQKVCDLLCFVNLHEKGFIHTL

SEQ ID NO: 27651 - protein, 96 aa, Candida albicans
KIELNKLEIITKNIPRQKKKKKRLSNQISRITLASLYQNKELLMIIIKSSSNSSRSISVKVKSHRKKDPEIPRLKFFIETSHITHTGGILKKNENN

SEQ ID NO: 27652 - protein, 107 aa, Candida albicans
LNCRINSFNSLMCCLIICALSALEAISFNFTKLLFICLTVDSIMLSSMSTCCCWEGSSIIAYHQSDREFVYSSEKKKVDRECDKTFKPLYIYKNSIRPNPLLSQCFS

SEQ ID NO: 27653 - protein, 63 aa, Candida albicans
WYAIMDEPSQQQQVLMELSMILSTVKHINSNLVKLNEIASSADNAQIIRQHIKLLNELMRQLS

SEQ ID NO: 27654 - protein, 108 aa, Candida albicans
EDKHDDAIVTPQETVAPDTNSPDADQEQPDSVEPDNETTDAPINVEDDATALISDEDTTTSTITTLIYITQSGDQPIKTPVPIFDNAANLAGSISLSSGVLLLILMLI

SEQ ID NO: 27655 - protein, 148 aa, Candida albicans
IEMRVSTLVLSTSIIPIATALNISPFHNIEKKDILADAASAAGGAAAAVTSGAVGAANTVASGAAGAADTATSGAAGIANTVASGAAGAADTATSGAAGAAKNGTSSAARAAETATSGAVGGAKTANSGAAGAAKNGTSGAAGAAPWC

SEQ ID NO: 27656 - protein, 145 aa, Candida albicans
LINIKNFLVHFFFFFFFVNKKTNHPHPPCDDHQILIIKLDNTMSILQGYSSSSSSSSGSSDDEKDNERPPFKKVKTFAGSFQQILSSILENDTFHINNDRKISNNAKKLAKQLKRQRYKQGSRYGIDPWTNNSSDKYSPRAEDRV

SEQ ID NO: 27657 - protein, 60 aa, Candida albicans
SSKCSISKINQVVPFFFLSFSSQLIFYFISMFLVVAHVVVIVVTVSFIFVELLSKFFLNI

SEQ ID NO: 27658 - protein, 78 aa, Candida albicans
  UNSURE (3),(7),(15): Identity of amino acid sequences at the above locations are unknown.
VSXYLAXAHVKKRRXRVHKLYIQPQYYSTNQDIQIQNKTKWSTRGHHNSAKFLNIVINSTIKTPTTPPNNLFTRKKYV

SEQ ID NO: 27659 - protein, 60 aa, Candida albicans
NGPVSLIILQWLNMFDARSYWSEAGDEEKRKKNLKDLGKRDYYFFSDLQVEGAAPPKLTS

SEQ ID NO: 27660 - protein, 85 aa, Candida albicans
QWDKTDIGSLSLTNYNLKHVVNLNTNINKVWGYETKDLGCYGKFTKLLFLFSHLVLVILVLLVWFYFSLGLKIILYCYYSYKVKD

SEQ ID NO: 27661 - protein, 76 aa, Candida albicans
IKFINDLLMLNTKERKGEGEGFNSLVFFFHSSSLQNGKLLFLDLTMIAAKKKLALCFIPFWPLFFDTKEKIFRCDF

SEQ ID NO: 27662 - protein, 87 aa, Candida albicans
KMYDHKTTDTGISIRSFISLRHGGKCQFKKKFTKGCPKKFFLVLTGALLLPIYINGVLNFKLKIEESWVITLVGTGGEVLCTFKVTI

SEQ ID NO: 27663 - protein, 113 aa, Candida albicans
TIAAKNAITPESVFDITITNGIFRSGWAISSVKCTAPSNNVTQAKLGNIPKKNTTPLEDQPVSLMIFLNTNSADCFGDLTKSVIIIKNVPKFITATEILVINGNNLTKNTLTK

SEQ ID NO: 27664 - protein, 81 aa, Candida albicans
QIMRSKVMATMNPNITTGLPPTSIHVLTNVLIASAEHIKLNENPMYFINLRFFSNCAWGNTIFRDNINPVFPFCTLTRPIC

SEQ ID NO: 27665 - protein, 64 aa, Candida albicans
VLPNMRSYSRDKNAVLNLSATKDVVLNVCSLFCGLKCVVLNLSATKDAVLNLNALFSAVLKMCS

SEQ ID NO: 27666 - protein, 77 aa, Candida albicans
GHTMKSRIGATQSTKKLDIRKLKSSEPGLFRGTLLCRSRRLFSFTEILAEKRTMTGDQETGGASRVCFDYVCVVSAI

SEQ ID NO: 27667 - protein, 70 aa, Candida albicans
IISILIHYHHFTLTINVLQDTRKISLECDTKFLKASNLLTQITNPSTLILFLFKVQNPTPIMIPTFIFEF

SEQ ID NO: 27668 - protein, 180 aa, Candida albicans
DESGDFLDDEFDIEAPPRFPQQLQQSNISSVANKNQNIYGNRRFARSSKLSNYKDNLSAVNLLDQEHGGVPNTGNSSTSNFANVNDDDDDDEIVGSDVDDFISGSISNSTSNINNNNDRGGVLGAILSAEEHAKWFTRFDEEVLKPVLLDTLPSTGQSSQNNSTSNLNSSGNGNGKRNQS

SEQ ID NO: 27669 - protein, 63 aa, Candida albicans
INFHVKDFVGAEEYASLVYDVLSKMLQVKLSKRPSPLELNAVKFFTRCSHNLHHAVEVRTCDS

SEQ ID NO: 27670 - protein, 211 aa, Candida albicans
EKGSFPQPNGSNTDIFRTNSGSRGSSKEGSTTDLPRYISSMQNRSRSSSNPMTHVHVAHNAKDSYFPSTILGRVKSPESDVSIDSLGEPIPEELDSVLQAYQPTLNEPAGRNSPIESLNRARSLNKRRTNNPLFSSSTQRKLQQLLFQPSLTQLSKVNRQRSLSSGGENRPGLQQKLQRHYGKDNTYEDDGDSEEEEEESNEITDEEDDST

SEQ ID NO: 27671 - protein, 288 aa, Candida albicans
RVPLGVFKVEPSPQQQINIISQEISLKSKKRRLNNSHKDTNVIATIITITTGTTCYVSNTYTNGSSPLVHGHNFTTTTNTESNSRLHGYNLETGIPHSDQPQDSQWISNELKDAALVTAAALDTQFLDLMFNFNSNIPTDDTSNNINNNTTTNTHTHTDNQTNNNNNNTGHSSIMDEFNNPDFLNLLFHKNLQLAITTPQPHIGTTTHTTTPQLFHSNSSISLANILNQNQGANNNSNSILMDPTYYSNFSNFFYNNPYQSNENLEIDLHAKSIDHDHEYSPRGWKIR

SEQ ID NO: 27672 - protein, 97 aa, Candida albicans
LNRSIIIIIIIITTYCLLVHLSLTIVQFKYNLSDYITIGSVVVVVVVAVVFIILFDSFYWKCYCKTRIRKLFSPPQFKSMIILYDYLLCGLCVRVCV

SEQ ID NO: 27673 - protein, 115 aa, Candida albicans
SWRNALFFSIDKTKKGKLERKKKPTLNTLKVYLKTPETTTWGETINTISSDYILLIKIIKSDLYQSSQILKKEVSKYTLFSFFFLHFINTYIIFCFVHPYVIIRKFNNCKWCFTG

SEQ ID NO: 27674 - protein, 85 aa, Candida albicans
ELVFFFFLAFLFLFCLLKKKEHFANFRDPSSFWNAPDINILKGNINNLINSLKYSKLHNHSLDHHSKNDQVLFLPRELTGPALTY

SEQ ID NO: 27675 - protein, 60 aa, Candida albicans
ASEFVLQRLLKMVVKGSIEKNSNSENEDNHPSTSTSTSDIIITDDNDIKSTRKRKVSDNI

SEQ ID NO: 27676 - protein, 67 aa, Candida albicans
QHGKSHSLRYEKLDSQAVMRIVSNRHLRPPCAKAHISETPDLSSSDSTEGGKAVLRAKSASVNCPSR

SEQ ID NO: 27677 - protein, 91 aa, Candida albicans
FFLDCQFYITICLAFKLFFFILDVPPLLIINKFSVSYSIVLDQIQTHIDLQLKNGIFKIYLVFIINKCIENCRYYTLFIHYCRNLVFSYQL

SEQ ID NO: 27678 - protein, 62 aa, Candida albicans
ILKNFFFFRFSIISQALYLFNTFFFFFIFQTVSTNITIETISDILTHYHKKNVCTQRRRSSS

SEQ ID NO: 27679 - protein, 62 aa, Candida albicans
  UNSURE (52),(59),(60): Identity of amino acid sequences at the above locations are unknown.
FIIIIQHQLLNNLNNLCIIFFVFFPVLLYNFNSDESQLLLFFLLILIIVKIXFLWSQEXXSF

SEQ ID NO: 27680 - protein, 78 aa, Candida albicans
PIIHFTNKGKSCSGINGYLLMGIKKHTVSPLTAKKSMLVNKIPSPMATQIKEEKFLSPGTTTWVTVYPLKAFFFLIKI

SEQ ID NO: 27681 - protein, 96 aa, Candida albicans
  UNSURE (28): Identity of amino acid sequences at the above locations are unknown.
GVSCGRAFKLFLTLNRELGGELILLGNXAGAFMENQGILQFLHIREVGKFHQKVRNILLFPFMWGEDIIRYLPRQAVTKLERLGYYSIPYNCSNKQ

SEQ ID NO: 27682 - protein, 92 aa, Candida albicans
  UNSURE (10): Identity of amino acid sequences at the above locations are unknown.
NTRTMRNQNXSALREHFGRARASSTPKKLSPVRLSYTNIPSNLRPPLPPKFDDSDIATAKSLGRIRPMVFPIDDQANFSPMDRTKLQSRNAM

SEQ ID NO: 27683 - protein, 67 aa, Candida albicans
TTPKKIWFFLEYTIRIFLYPLVIFVNDNYICIYLSSLTVFMMSATSSIITSNDGELLVSINPPFPLI

SEQ ID NO: 27684 - protein, 62 aa, Candida albicans
RSISVPFLQNKLRERITQTNSKILSILNSECRLYQFHYIITDSKTGESEKGKIQPIVSSALK

SEQ ID NO: 27685 - protein, 105 aa, Candida albicans
  UNSURE (103): Identity of amino acid sequences at the above locations are unknown.
WSLSEKYIKGHLSNLVFVVFAFQHHQLFSLIVTMSTITLTRESHKNPAKFRIKHQDELDILGPNRKDRFAINEDLPTITSTSKMPLMVAVFESMAGAPQTYDXYE

SEQ ID NO: 27686 - protein, 64 aa, Candida albicans
NPFAESIESLSEDVSAMLREENVVSSKFIKLIEPPYVLHLTVLSVQKKNEGTSTKYVFYDWLEV

SEQ ID NO: 27687 - protein, 78 aa, Candida albicans
LMSNIGLVIIIWSYSMKRLQPSNYNKSRTLKSNVIIILLSYYVTCGNFYLIGDIVYFYIAKNEGNMSINIKTSIKSQC

SEQ ID NO: 27688 - protein, 109 aa, Candida albicans
KTYLVLVPSFFFCTDSTVKCNTYGGSINLMNLELTTFSSRNMAETSSDNDSIDSANGFQFPPHNSWKSRIKHFFYLMWNGPSEPRDEPAPQIVFLEFLENIPDKFKERL

SEQ ID NO: 27689 - protein, 69 aa, Candida albicans
FEGCNRFILYDQIIITKPMLDINHLYKSRDTNNFLSRHDILVREILTVQTQINLPKVFPKPPTSRKRHI

SEQ ID NO: 27690 - protein, 66 aa, Candida albicans
CKNHSKSFKVPFGGEQERKKERENGVIFFFSFASAPSFHLSLAFLSPFLSVSSPRLQPRALQGTEL

SEQ ID NO: 27691 - protein, 67 aa, Candida albicans
MNYWLQKKKKEYKKIKKNRINNIITILVGNEKGQKKEYTYDFYYYHLFIHSTPISCKIILLSRDDYY

SEQ ID NO: 27692 - protein, 64 aa, Candida albicans
KKLMKNLFVIYLICNLSQVDKELLLLLELFFIYAFFFFFFFTPMTFINFHSKIFLFFFFFSRKW

SEQ ID NO: 27693 - protein, 65 aa, Candida albicans
ADFQPVVKNLNLELSASNLKKKSKRKCVYSFRSIQALSLLYFTTKLQIDLIFATSFDPKKNYTFD

SEQ ID NO: 27694 - protein, 61 aa, Candida albicans
GIFHWTKFNQTRISKLYKSFDEIVADIYSTLDDILGKVLFSCLNMSFIRQSSCNGGRCSIC

SEQ ID NO: 27695 - protein, 105 aa, Candida albicans
SDLSLDMGKIYKGLPFFPDTNYEVRKNYLAGDQLQSEGYNTELIFLKNTIVPQQAFGRFSNSLGSFKPSKKFPHWSIALGFKLPPSLYETNWVYLPHPFTSLGFS

SEQ ID NO: 27696 - protein, 93 aa, Candida albicans
QSIFTIYIQKKPYFYCHIKAANNLYHKLVPWPSRLTRGANKFNLLRQDQQFDPAMDQFFFAELRLPSSTSNTQSRIDFNFFFEPHISVRKLTC

SEQ ID NO: 27697 - protein, 316 aa, Candida albicans
  UNSURE (306),(308),(310): Identity of amino acid sequences at the above locations are unknown.
KPFVINLDQGAGLFYINSTSPLFTLRIVRNNYTVDPLTSNGARISRSRSRSKSVGHGEAISPAYFSKNKTKDLVKQETAHIILKKLLNMLQDLDLQNPIALKTISQGSESKFCKIYVSNTNNCIYLPAASSTSFTYEDDENGGVIIAEDRNDEMPTAVNNNTLSMDSINHSETDFLDSPPPPDLFSKMKSFHSPNYLTSKIDSECPIPHTFAVIVELTKDSLIIKDLHFQFQSLTTILWPTGDAYNRTHAKEKFAIGNMEWRTSLSDADYYINSSNSNDVKLKNLGPEDLINRTREYKLINIKELXFXMXQDHWMF

SEQ ID NO: 27698 - protein, 98 aa, Candida albicans
VIQKVDDKIVIQLGFIIELELSLNILVISFPPLPLPLPLRPSFVYAELELYENLLLETNLSNQKNSYYQHLYYNILYNYPPQESKKKKKNPIFLLLLL

SEQ ID NO: 27699 - protein, 82 aa, Candida albicans
KLNYWIRYIIIIKGIEVMKPRESMMEFGKEGVRKLKTGERKNEGRKEGRRRLKILISRFLAYNYQGRDQSFNIMKQQLHCIR

SEQ ID NO: 27700 - protein, 60 aa, Candida albicans
  UNSURE (29): Identity of amino acid sequences at the above locations are unknown.
LNNNVEELLTCATEREMEFFSIFSQNEEXVFGIPLRIWWGEWRNSIIGKFVKQKLYRFRG

SEQ ID NO: 27701 - protein, 214 aa, Candida albicans
RRGKKDFQPLTPRSEPISGETTKKKRKSGKLNDNNENSNGNSPKKQAKTNANSKNLDPIIKEEENGVLSLKKESSTSLQDQDLDLNPPLAPTQATAMSNTFNDDPFDVHLLDTQHHHQQNSNNSNHNRGQNLSNGSNNLSVSGPGMGMNNLVFGDSTHAFDINFNIDSLDDIWTTTGPGGDITGTGSGSGGAGGTDDDNFMGMNWAADPIENGD

SEQ ID NO: 27702 - protein, 71 aa, Candida albicans
ITSKLYIDERVWSLSIHNNDDSTSLIKCMHVSSTIEIISTIKVLLLKLLSNRSKLTSIFLSFSHYQLSHRH

SEQ ID NO: 27703 - protein, 82 aa, Candida albicans
  UNSURE (10): Identity of amino acid sequences at the above locations are unknown.
NIHYSIHAPXYPPPNIFHNWLGIKIPRKREQEKKRKEKERRKENKKRTDREFKSNFQYKGIFHQTLDNFSNHVFLAIYKLYE

SEQ ID NO: 27704 - protein, 248 aa, Candida albicans
FVHTLHVGRTKLSESSGMMINLKDILISWNKLRSFAEIGIIAPNLESLNIVDCYYLMDYTTLKLSWKLQSFTIINSPYPIGLFDETSFPHLVDFSYKEVNAKNYHKVWSVSFNRIHESFNLQLFFPPNLKNLTLYGGEFAKSIGFVFMLPPLLEKLHIHNFRLKFPITKFPQHLQEIILKVPAVYILNQLRIPPQAKTVVIEAKKIVFRCMDFFYDLPEGLEKLTLHAINQGKILPCVHHGAGRIPRL

SEQ ID NO: 27705 - protein, 73 aa, Candida albicans
QPICLELLASLSNINKNAAPTGAQIPEITMGIFTLLVRRIKGPFNIEATTTDTIMGKMAIDDLKADLLKTTWK

SEQ ID NO: 27706 - protein, 106 aa, Candida albicans
NYFNNLHISLSFSLKLHQLSRRMNIEMKDQISNLIGRWWNLRIKFDLRVQKKKKEHPHNNNNNNLLSATADLKTKIIIIIIIILSAGTATITTTHPHTQKQSKINK

SEQ ID NO: 27707 - protein, 68 aa, Candida albicans
KPQSGLCDKPPTNQTEMTNLRELEEEIETYEGTSGDLQEQNVLQLPSRKTSLYQNDPHHNQKFNRKFP

SEQ ID NO: 27708 - protein, 65 aa, Candida albicans
IKTNKVCIIEREILDAIFFWIFIHAILSNLRNQIIVTRNANKQGKKKIKNHNQDFVINRRQTKPK

SEQ ID NO: 27709 - protein, 73 aa, Candida albicans
  UNSURE (8),(15): Identity of amino acid sequences at the above locations are unknown.
AFRLVATXFIGSSYXTLQDFCVADFVPKEGVSVLVPLTGISNYNILLVITSKFSFIFFTNSRIEKGIEYTSWC

SEQ ID NO: 27710 - protein, 65 aa, Candida albicans
FNGNEISVVGDMMKLCLTVTFKILNRCCFTANNGRHDKESIGTYKTGYGTMTMNEKQNFYFTFDC

SEQ ID NO: 27711 - protein, 182 aa, Candida albicans
LMIEKLTIKRSRQKVIAYSVIIIWLMIVNIWLLNNYHLNSSTLTRHGNGDNLIDEDDDLSSSSEYSIYNELDTENYLGQQHQEEDVPNSQSTDNSLIKPTSPGKNSFKDDITIKILQKHLQKQQNNPKDIRTKDSHAEIYNQIFENHPQIDTILGNLNFNQRCQLFFQNLFMSSPQGPKHPR

SEQ ID NO: 27712 - protein, 113 aa, Candida albicans
LFSILYAALSFISQTVKVLSVANLVMSATPTRELDQHTKSSPTKASQPKSFHAITTPSPTDSESITKEKKPSPSNPEFVSNWKNLMLVTPNTSSRSPVTDSFISIEKRNQSKT

SEQ ID NO: 27713 - protein, 132 aa, Candida albicans
  UNSURE (71),(83),(95),(126): Identity of amino acid sequences at the above locations are unknown.
GHQKSFHWKNAHRRVVSDGSDEISNKSMSKMSSPPQPPSLPLPLPPTSVHNQQPPPQLLPSLAIVTHPGNXNQLQLHVHLPSXTQQLVPPMVPIXNTLNNITNKVATDQETHSWQALFKKVMERSXILLWTE

SEQ ID NO: 27714 - protein, 65 aa, Candida albicans
SCSKSQQQETENPIVGVYEKLCEIWKIAVTGYTHTHNPCPRKKSEPDTKRKQPDKLHYTTTDAKQ

SEQ ID NO: 27715 - protein, 91 aa, Candida albicans
SSVSQFLYLFPFCFYFHFFFFNFYLSELSLSQYMYISLTHNLYTMLSLTSEMLKNSQQHRRVTRHLLNNIAKPSLRAFLYAYLYLVLPKAI

SEQ ID NO: 27716 - protein, 87 aa, Candida albicans
IGHFYHLELFFNFETFDSWLILLMINQLLQKKRNIKEKFWKINYGTKTSLKIVLFNSFFFPSGSYFLLLTSFVSVKYNNKNVLKVRH

SEQ ID NO: 27717 - protein, 65 aa, Candida albicans
KTGNKTCMYIYSTLFMLQPMLFLRSINYRLMRSINSYAINIYSMFVLLFGQNTAYTFSKSTHKTA

SEQ ID NO: 27718 - protein, 60 aa, Candida albicans
GCKTMQANNPKANQSIKDMVSKFVDDSKEKSIKQARETNKKLEATQRRKDSVNQGFIKRH

SEQ ID NO: 27719 - protein, 65 aa, Candida albicans
VAVVNYKNGMTIKPTYLMPWAIGHGAIPFQIKSNKGKFSHLKQKIVGPNFTLFKFMLLDSGCYGH

SEQ ID NO: 27720 - protein, 97 aa, Candida albicans
MLKTDSLDFHSYLPPYRSLINPNARYDYRTHSLIPLTQNDLNLLRIAFQKKKEAPPSAFKMKYKSLLSDVSRTISMRLSNSNLLSSSSAHTNIFTTE

SEQ ID NO: 27721 - protein, 83 aa, Candida albicans
  UNSURE (15): Identity of amino acid sequences at the above locations are unknown.
VEIDFPWDLEGCPRXNNCGDWIRANLNGKQYQIPFDHNLLESVIQCSPFFHICHLQVKQFKSIIYYKANLTTEKELTPFFKQV

SEQ ID NO: 27722 - protein, 72 aa, Candida albicans
IGNSHNYSDESIPKVHDFIPVFWMNFTLNVGKYSNLIRGAVNSKQFLRLWNYLICRVYGNEEKVKHWQLTKN

SEQ ID NO: 27723 - protein, 171 aa, Candida albicans
  UNSURE (134): Identity of amino acid sequences at the above locations are unknown.
SNKIIAKYNNNSNASKATNLKQQVVLPTYTLDSNLVLLPGIMYNVTFSRFKAAALLYRYKNFISQVSIINNLLNEYDFNSGNTNEEERFEAEQKLEQPETYHEINPSVISPEAVEGIKEFFQYETGMKTGRGVXKGVKSTQNDAIKEFDWLTLAIIPNLEKIKNPETNSSA

SEQ ID NO: 27724 - protein, 62 aa, Candida albicans
QTNKRGFPEGVVPNAVNSNGMSLDFFDVVVVAAAAAALLFVEFIELLGDMDVPVLVFCFLCL

SEQ ID NO: 27725 - protein, 265 aa, Candida albicans
KDIQKYCEPAIINESLLTNLASKLGILENELSHLKIQKLPLKEKLKAFVGEFLNAVYFGGDYIKILEKFTFEEGVELIYHLVSVLLQEMQANSDFITWKVIYLLLKFFDENLRLFKFKFVNFQFKRFLKQLVELPKVRQRSSSTADQYCRICCLLCITSILRYCKIIFEGYTDLNEIECYWVLFSNAVHSYNADKSKFSEYVYSSFRMQDLLNDFRFPKDPNPQDDILQESLQVAHRVLVSEIDLIDTTSGEVPDTCILDYDYNF

SEQ ID NO: 27726 - protein, 75 aa, Candida albicans
GAHSVAYVPSPMVKTSTEIRQLITNDVDSPVSVNSDSTSNVQSIEPVDTYSSAEIDNLLGNIQWFDQWTDFNIDF

SEQ ID NO: 27727 - protein, 92 aa, Candida albicans
IKRETETERKSGGTKFIIHHPAEEEEEEEPILYYTNHFSLKANYKTTIKDVGIYILYTNKLFIKSYLKKIYIQVISFSSINLMEHPFFFKEI

SEQ ID NO: 27728 - protein, 90 aa, Candida albicans
LAVLLLFSRFTWCCLKSAYFNRHKSFKGNGRELTERRSSGLVNSFQLNSSPDIPVAIEMKNKKVSSTITSIVDHEIANWNSCLILVIFAI

SEQ ID NO: 27729 - protein, 61 aa, Candida albicans
LKKKKKPHTQTHTPSKDFINQDIHPNSLPPSYYKPCQHLLEEDLCVILKYVTPPFFFFFWL

SEQ ID NO: 27730 - protein, 61 aa, Candida albicans
EVIIIIDINQLLVIHWHKSIQFNSIQFNSFKFNSIQLSNAFGLVVHAFFVVERKKSKKFFL

SEQ ID NO: 27731 - protein, 209 aa, Candida albicans
TKMVLKNSKWDKKAKYKYLKKHNILPTKTEKDNANTTPSTKWSSKKKPIDNHTTGVTLEDSDDEWDSDIDDALINHFYPQLSENDELTIEQKKKIKLQILANLDKDNEEEEKEKEKEKEGKESIENTIEDELDGIYLGSDDTNKLKELKPNINGADSKFDLEEFINNLDIKPKKNKRKLLHNKISDNFLEEYGLSSYQELNRNVDDYNI

SEQ ID NO: 27732 - protein, 154 aa, Candida albicans
PHICKTEKQKIFLFLFRPYRNHHLQTIKFPHSKNRTKKRRQLDTLLLLLPSSNQTMKVTNVISFATVASTAVSLVIPDITSFFSSFNQILIPHHQQALLINQDAHLPSDDNQPDTKTGILSNPLNKIIPNHYIVVLKDDLSQAQFLQHQNGVQK

SEQ ID NO: 27733 - protein, 95 aa, Candida albicans
  UNSURE (13),(25): Identity of amino acid sequences at the above locations are unknown.
KLAVAVVVVVAVXVAVAVAIAVAVXVAAVLVVEVVAVAVAVIIVAAENDGFDGRSDVVAITVVVVIAVVAVVEEEHAADLKVAALYINPDNKELV

SEQ ID NO: 27734 - protein, 293 aa, Candida albicans
  UNSURE (266),(278): Identity of amino acid sequences at the above locations are unknown.
PLGDAIDTEQNLREDQTAEAVDPADSPISVINVTLDPPNEANKENSTESSISLSNLSPKNRESSLSSSSPQSVPPSMITPISPMSAQASSDKAQVLHGDSNTSNQPRYTSSPDSAALPLSLTGPNDINEENRTPQSHNLNNTDALHGQDSSNSQAVSNSRSIQSVPTAAVSSKNQGNQHSDDQIRSLNEEIKKLRQALYYRDLYIKRLPLNQQHALLQQQQQQQLQLQQLSQQRPNDHQIHHFQQQQLLQQQQQRQLRQLEQQQRXQRQQWQQQQQQXQQQQQQQQQQVFTTG

SEQ ID NO: 27735 - protein, 223 aa, Candida albicans
FRNSSPIYPIMKQNYILLIILCYLLANVHSAPAIITVWQTVTDAQVAAGPTAAAPAANANANVQQAAAASAPAPAPVASPAAPAPASSAPQSSTPSSSGWLSNLFNSFFGGSDSDSSSGSDTASAAPASTSPQSSSSSSSSSGNSFLSFLSGLFGSGSSSSTPSSISQQQQQQQGSPASGSNSPNSAQPDAAAASNPVPQSNNNQGSGLGSGFGSGFGSGSGS

SEQ ID NO: 27736 - protein, 70 aa, Candida albicans
VLVTKREKLLSMSKKKNKTGNEWQIEINNNNINKNQQNQEEIYTNKTKFNFLGGGREFYFILFLKRNQFT

SEQ ID NO: 27737 - protein, 298 aa, Candida albicans
  UNSURE (16),(18): Identity of amino acid sequences at the above locations are unknown.
VHYVDTNNNLLLLLLXLXLNKIKTQSSLLTRNNSINNKSTKIITNDTDSSTIKPEKNNSGHNSHRLSKLFIRNNNNNNDEEEEGFLDDSSTIITPTIKYFNNTISPSSNSNSNSSFFYNKNKAPTSNSSDGSSNRKFKTSSLSNKSPLSKTFKRAYTKVFKKSQIIDTNNNNNNNNNNNNNEKPRLVIRKTMLHDILPSDSDENEDNEKQEEEKAEEGINKVSPNHNDNNNNKDNKKEDEGIENQICIHKSLIFRDVLPTNKSNHTANITKENQYSEHITISPIIILDYMNDLNLKYQ

SEQ ID NO: 27738 - protein, 65 aa, Candida albicans
RIGRNRKFRDTFQPILYQQIPKKIQPPSMLLPLPLAITLTLTTNHQHPKVWFNHLIPIWFNTKKF

SEQ ID NO: 27739 - protein, 156 aa, Candida albicans
FHLTSIMASNQPIMPKINNPLGILRTSQAVASDITINIILYALIYSIIYLFRLRNLFLQFNHYFITIILYILEIFWIILYIIIRLIYLVYNTINDSKINDYRYNTHGILRTFIIHNQFWKFKNNLVMNSIFKHGPNVFLDIQDVFSTGLDNQTAAT

SEQ ID NO: 27740 - protein, 64 aa, Candida albicans
LVCSFDWSTKQMHTHIYNISSRYGKKKETQIERLRNELKSLNLLIFEMREYKYGNAKLRFRNYT

SEQ ID NO: 27741 - protein, 104 aa, Candida albicans
LMNFLYNNSDYSSTSHTMKSPLAYNQFPKLQASNSTAGNNNTATTATAAAAAASASASASVTPQLISPTTLTTPQNKYKRGGLDNTLPKLETTRFSPRPGRSAF

SEQ ID NO: 27742 - protein, 106 aa, Candida albicans
VSWDMTDTITFLRTCIVTTSSSIEQKDNIKFDVIALLLHHHPIVILCRVTIVFAPPAVLFDSLLKPFLPASIRKCHWKIYTLVHIDSLFQKRYTLTHLIKRSHHTI

SEQ ID NO: 27743 - protein, 236 aa, Candida albicans
NWFNIVAGYALSFGKTMTLLKRTYYFFYAAIVVALAAVFPSIRGVFLVDPWNMIFARTDFDNLIYKISPSDLPKDEQYQYLSQLSKKLLRVINFFTTRRKLLLNYLGVKPHPFLHFKYMEKVEPLNDYDNVVRFKTEKMDFQEVMITSFNVNNIINVSNYPLMRMLYNNSDDNYQTFKRVIEKENHDQKVRITKFRANYERKEGKNIDTFNSYDRIRRTQSEGLQDLNELDDIRLR

SEQ ID NO: 27744 - protein, 73 aa, Candida albicans
  UNSURE (29): Identity of amino acid sequences at the above locations are unknown.
FTSIVKYDTFHCYKFIKFLYDISNYTFVXYVETNSDWEGAPELLNCIKQIIVKEFSSFESYLEIVEWVQTLNI

SEQ ID NO: 27745 - protein, 275 aa, Candida albicans
  UNSURE (48),(52),(275): Identity of amino acid sequences at the above locations are unknown.
LTILSQSCRGCIDWIDSLNSRLEHVIIHQKNELNESPNDELTRKQKQXTVDXYLSMHFDQDYEKLVLFLEVQDSHYPQKDSQKEEIIDSNDEDEQEEEQDNDNDDEIIEILSLEPEEEVSEQPTTQEHYGQFHEELQYPQMTHGYNNNFQMSGIDYGTNYNQNIEYDEEEDVNEDEGDEFDGFIDEQAHEVQGSSNYEDEEDEDEIIDEGDEVEEEEDDEQYSYGTGAQHQQRGYGITNVPGYTIVNGRPRLSDNLEYGHVETFDNKDGEEEVLX

SEQ ID NO: 27746 - protein, 70 aa, Candida albicans
YLCTTCINTYNLLLDILLLRILRLPNTVSHTYAGEHSVLEVIIVVFNQQATRKKEKDKLLVSIICVNIPD

SEQ ID NO: 27747 - protein, 71 aa, Candida albicans
HHTDQRDTWLLFLTDRRFNEAPSHTPMHFLNNCSGVILFTILIRIIACHLKFLYLHKMLLANYNMYIFAPI

SEQ ID NO: 27748 - protein, 60 aa, Candida albicans
LVVDYISMHQIIKLQQLNLYCKKNLLCMGAIQIRDFGDHSHVILTSTFRYLDQYCLIVGE

SEQ ID NO: 27749 - protein, 254 aa, Candida albicans
  UNSURE (233): Identity of amino acid sequences at the above locations are unknown.
ACVFPAPWSNTNTARKRNQSQNNRPRQNSNPRDEAIARTRTRRRSSLFQDSRESHLDVSKNNTVPNTSTTQESSSKLWSGLTKPLDLIQQFDSMLQNEFEKSLINERDQKRQLHSDNGKRLSHQSKSSEGSISSIGSINSPLQAKSKAFEQKKSNMNSRTTTDDMLQNVSSSIWSFVNDVKNNVLSSLNEVESETRSKPTAMYNLETGSAVDIRRPPKLTANETEGDSDTDLXEPVASDDEDNLETLDLSIYRR

SEQ ID NO: 27750 - protein, 62 aa, Candida albicans
SVFNHFPRYPHVEVDVNHHDKNAFKNKMPPSIRNISRKENFVLESLMKVAPVGRYYSNNYSL

SEQ ID NO: 27751 - protein, 74 aa, Candida albicans
MQWMYKHKNFSSKSRLIITYKGNYNHFLKNTIYEKLNIKINKSYKLPIHNSMHRSNYLYSNRCSFESFESFYLG

SEQ ID NO: 27752 - protein, 136 aa, Candida albicans
KMAGRKRKNESKKPNPTARSTAAIFQDINNLDELESKTKIDNNKSNEETNDEPAGSPEEDIANAGFPFNYLYRVQDHLNENMSVVHDVQCLVSLFFIQMVYLDRVKIIDYSKDEHLPMQVIAVIFFNWVGVFLCTF

SEQ ID NO: 27753 - protein, 109 aa, Candida albicans
IQIITTTTTTIVTIIDAYHLPVKSHYIRLIMLRILSNKRRKTDIGITYQDYGIISGDSNLENDYNNSNNGNSMNNINEQDEHEEEQGDETYGDQMLLIVLMKNRMDDLL

SEQ ID NO: 27754 - protein, 116 aa, Candida albicans
DIYCHNCLSLFYISIFPTIHSRKQYNKTQLTTNAHREQMAKSILKDNQNHTAPIVFGDNNNNNNTNTKNDESGITVNSNYNNNNNNNSNNNRRVSFAREVTLHKIDYVENPKQQTT

SEQ ID NO: 27755 - protein, 106 aa, Candida albicans
YYYYYCYLQIQLALYGFDYPLICFLPFVLCGRLLLVVFCYIVFLNEWLEKYLCRIVINSYDNIYLKLKELVKRYKVADSIMYQFKEVSCCCCCCLWLSVVVLFFLF

SEQ ID NO: 27756 - protein, 148 aa, Candida albicans
RSGTRNIYSHKHTHTHSTIIMSLDYTKDRKTTITFDEKQLPGTPPGSITTLTDLNNNNNNNNDKSKDHEIKPQELADKLSDAHSNLLPKSQIIIILLTLALASIVSFMDQTGITVGLSEIGKDLNAQQSINWAGSAVFTTPARIHVPP

SEQ ID NO: 27757 - protein, 84 aa, Candida albicans
FRRGSGSPVGEDKIFTSHLDFTGKNTTPVVHYLLSSHDKYVYIPFLITCLFIFSLFMTYAKIFQHHQQLFLLTHDLSFTNSLNY

SEQ ID NO: 27758 - protein, 61 aa, Candida albicans
  UNSURE (20),(38),(39),(52): Identity of amino acid sequences at the above locations are unknown.
HYYPRCVSKHNVGCLHCGLXFNTRIVTYSTVHKRSVVXXCLCGTGFSGVLNXDVIIIHLPR

SEQ ID NO: 27759 - protein, 71 aa, Candida albicans
YLIMQYDVIERAFCVCYGIFQIFRWGKGVGDATNTNALHAMSDTNLVYTHVSIIVNKLFLETENQLTLFCL

SEQ ID NO: 27760 - protein, 74 aa, Candida albicans
SGILESVHSLVVHYSMVHFKYLFFFIWENCYCKDTSSLTQLKLWIQTLFQQYKDSFQENTDTHYALFFLVLFCS

SEQ ID NO: 27761 - protein, 62 aa, Candida albicans
KYGIYFEMNKKYVVFHQLNQNPKTPYLHIHSQRKKERKEKPTKEIKINSETEETKKKNNNNK

SEQ ID NO: 27762 - protein, 77 aa, Candida albicans
TITIISVLIIHPVLESIEISGEDQKKWAIHTYLHKHHKPIIQEIKETTTENFCCLFITHTKIAFIFFGLLKLTISCI

SEQ ID NO: 27763 - protein, 70 aa, Candida albicans
  UNSURE (69): Identity of amino acid sequences at the above locations are unknown.
SGKQYQSLHTYILISFQSILFLYFNKQRKTIHYQKLSFVYMAVSRGRGRNGGEEEFGTDTRPGTNGIIXR

SEQ ID NO: 27764 - protein, 104 aa, Candida albicans
HKLIFMTYISHIHNIQTKSKCCLNFLSLICLAIITNAAVVKRDEPKVIRMDVQQGVSELVKRGDATGSSEWTQVFYSYADLKIGSNKDPVNLSIDTGNWVDPIC

SEQ ID NO: 27765 - protein, 66 aa, Candida albicans
ITNNKIFQLKEGSSCLFVHSIIPPQITNMYAKFTQSQKNWKPLDRRESGSNYYIPKNGTEFKIKNS

SEQ ID NO: 27766 - protein, 323 aa, Candida albicans
SSNSVLTSSILSETTTNESSSYTDEPSSSEEITNTYEPSSATELSTTDQFSSLLSSSLPVTTTSSTTISSATPITTVLSTSITSQDTNCEATITNMSTNTLIETITVNGNTTIYTETQLSTYLTSNTNINCPNTNSATTTTTRVIPTATTEQIHSTTLNGSIIVFTETATLETTVIITHCPECTNESSTTEYSSSLKAESSQQSIPTIESNLLELSVSSTLSLVESTATGKCLGLTTTTFTSVVSTTSESIYTITSNESTFEMTTTVTNIRTIVITTCPTITPVSSSYSSNESSSSSVLTSLLTESNSNYPDNQLSQLNNFHF

SEQ ID NO: 27767 - protein, 89 aa, Candida albicans
ADLSSRVVDTIYDELSFTVDKFQNALDELFASIKNQLDTSDKNVKLLAQIDKLLEMNGLFTHLSRFNTVFKKFLTKLSNEKEVYLNSKR

SEQ ID NO: 27768 - protein, 62 aa, Candida albicans
LQDQGHQIESLMDSHADVQTEVQMGNRTLSQATKKNKRGANMLVMLCIVLGVLLVLVDYVSF

SEQ ID NO: 27769 - protein, 199 aa, Candida albicans
RSQAVVKMVLLDRPPPMKRQKNPNQLALSVPNQQDSTTSTGTTGVSFGTQNQTTSATSGGGLFGANKDQSPAPTGGLFGSTTTSQDAKPANDTATSSELKPAINMFGSSSTTADNKLGSGSSFGSNNNPLFGGKKDDNKSSAFTLGSKPENNEGPKAPFFAANNDTSKPATSGFLFGAKKDEDKPASGGFLLTVKKDDH

SEQ ID NO: 27770 - protein, 82 aa, Candida albicans
PPIEGESGYIRAYNFVITLPNIHGESTFCFHLYSFLSPFELGTFKSFTFTMKYIYMYSCQNQRKEKKTNVIILSKLEEKEIY

SEQ ID NO: 27771 - protein, 71 aa, Candida albicans
  UNSURE (34),(38): Identity of amino acid sequences at the above locations are unknown.
SSSPLPRCCGTELGFLVDLKRAQQTASNISRLEXMGWXNTSGTYNMDSHGFPFKFEPKNVLIAGTLLVFFS

SEQ ID NO: 27772 - protein, 103 aa, Candida albicans
ASSFPSSRGREYKCNSHGKCTQVGDNWACQCEPSFNKTTSKTTTWVGHDCSKKDVSVEANLFLWTSIALVVILVGGIQLMFGIGNDPLPGVLDAATIPKKSNL

SEQ ID NO: 27773 - protein, 95 aa, Candida albicans
RHNGILKRVKRVKRVKLIRFVHSSPPPLPPPPPPPSICNNNQDESESSKPKLCREIRSRKVLNQDQDRIVKKKKQVRLKLKLKLTRDHENNLFRK

SEQ ID NO: 27774 - protein, 183 aa, Candida albicans
ITTTTQQEPEQQETATRRTFQKKILKLELKDEPQPQEEHIPQDYPMKEEEENLNQLSEPQTNEEDNPAEDMLQNEQFMRMVDILFIRGIENDQEEGEEQQQQQQQQEQVQQEQVQQEQVQQDQMELEEDELPQQMPTSPEQPDEPEIPQLPEILDPTFFNSIVDNNGSTFNNIFSFDTEGFRL

SEQ ID NO: 27775 - protein, 81 aa, Candida albicans
NETRRKSKRIGVLLLLLCMITISQSLFYRYISNGIDANQIVKTESDKLILGVWSHDKRETNQTLVVLLVRICEERQQTQKS

SEQ ID NO: 27776 - protein, 180 aa, Candida albicans
TCMFVLSKVSGQDALSQSVVIYPLNYTACVVALTASGQKLILYKVEYNELIYLESIDFDEKVLAITKIKIDGQEAVVYLDDQSQIGILFIDNEFCTTIKILAKLSSTGQSKIIDSPVYMVADPAANTKFIAFHIFCEVVHVFHFNSILSVDDILGKNPNNSVSPTRSKNMRTDLGKMGVA

SEQ ID NO: 27777 - protein, 82 aa, Candida albicans
YVPFIYISIWYVLLLFLRSHVQSRNNNSKAKNQTKLEYLYWFDKTYKQTRTDFSIKNQPYIIILVAIRNYFDLEFITKIFFL

SEQ ID NO: 27778 - protein, 63 aa, Candida albicans
ALPINIYILLLLLLLLELYRDKKWITKTKTPPFSPFHLFTLFFLTQKFIPPSPPPASFFFQIF

SEQ ID NO: 27779 - protein, 98 aa, Candida albicans
LIDSVVIMPMDYLTPSTLPHPKLKRTNTGFTPNQIIALDAAIPESAKHIWYKYSQLKILDSHKRNGPEDEDNVKSVVDDPDRFEEEFVKHVETSLGRS

SEQ ID NO: 27780 - protein, 178 aa, Candida albicans
DISQYLNKRQIELKLDTINRQINIMIGELWKRDIEFEDINLLPYFQKFVLQTAIFIGYGIELDCYKEHSQFCQEIIDIENKIIRLRSPISNLQDSIPLLRIMPRWFNNSEIARMCGERRNSYMNKLYQQLQQGLAEDLPQYKNSILGDLITKTTNTHNNNDDSSDTNCTSHNNCLNEQ

SEQ ID NO: 27781 - protein, 247 aa, Candida albicans
LSIKKFINRSNLSHLFVGFLNLNDETNSNKILETIHKQNNTTNNTNNTSNSFLNQYELNGIIKKLLTNHNDIIKSLQIIENLSWNHCKWSYFEIFKYILIEARSHQKQDVETFLKDFQLRIIENFKDEFFFEELTILILKHIAIMDLRDGIRLYNKILKLSNNTNVIATTTTTTNKNRRSPQSFTNSNTIATKGNLNTNDLSLFEYLNIDEISDRYTLKSTDKRMTILLIPNERLKYLPEWLIDKNY

SEQ ID NO: 27782 - protein, 88 aa, Candida albicans
SWRIFDDNCRLIELEEPKFIQSVAQLDRIDKFISKRLRINLDLRLSLEEHYELNTDNSQQDDDSHDDDDFDENKNLFYYYFVDLLQSL

SEQ ID NO: 27783 - protein, 117 aa, Candida albicans
LLTSDFMEPPFPEPPVVQVDAKPISKVSVNDIESERVATEVECELYWLVISDSEVCGLSDLAPFQVDEISVMISFDVNGNGVVTTEATDVLDSRIKEPPELEVSQTDINCSSLALEA

SEQ ID NO: 27784 - protein, 68 aa, Candida albicans
SGGGGGGREEFIIFHWNEYIDDDDDDDNFEMFYVYIDHFIYYYYFSLFNVLLLLLLLLLYLLYLLVSG

SEQ ID NO: 27785 - protein, 80 aa, Candida albicans
RNPSPPLTAVANILNFLVLVSSVTYLNLSLRAIFFATLVHMGALPQKLIKRHHKTGSKRNIKYSLFVMVVTGSISGIQVA

SEQ ID NO: 27786 - protein, 84 aa, Candida albicans
FVIYITKNRLKFRHLFFLGEIKKPQEKKKNFVVTLLKKTTTMFGSPFTNNPTQKSSTPTVFKDNVRNAHIYTVTMVTTAISDHT

SEQ ID NO: 27787 - protein, 107 aa, Candida albicans
VSNKWTYISFLTNLTKYKLDNIVPEVISHNPIYKLSKMTTNNTCWLWGFCLNEYQPSKLFSNTISYCIREFFNGLTILEYFLIFNFSTTLNYLDHHTYTNTQNYRGK

SEQ ID NO: 27788 - protein, 145 aa, Candida albicans
  UNSURE (11),(100),(101),(131): Identity of amino acid sequences at the above locations are unknown.
LGKQDTIEESXGCDVGYGLLHRIPEVVGKFDNNSIVDDILFENSQNLGYQQQQSLSPQHSSYIPESAENTQENNIINSPPPVMGAGAPPRASTRKKKHVXXKDTFEGLDDYMNEELEKSKKLDVASQPQNXSGTPPPPPPPQSSK

SEQ ID NO: 27789 - protein, 156 aa, Candida albicans
GMTIGCWAMVKRTGCDVSIGNCQTQFFHIIDEEKCDHTIKLQKVNQKSKQTTSVLDKVVTNLQSQSVLGRVMTSLLSLSIIPPQPSLTLLEILASNGCLMLLEGEKHNVTVTLANHSAQSINYLTFSFWDSNIEFLNKKLTNPNLTAAEVHELEWK

SEQ ID NO: 27790 - protein, 158 aa, Candida albicans
  UNSURE (148): Identity of amino acid sequences at the above locations are unknown.
YSNNTMVWVNGCPKFLIDLPINEDIIDIAHIYHTPLLTVLTKSGVFVFHQHTLLPLASHVRNTQSIETNGYNIQMKTKHVSVNTAKLQKLSIVNLFIQSENNFLIIYQISINYSGSIYEVHNKNDELIQNGLPLSSTSLGFSVTDFFXSANKSIIHGN

SEQ ID NO: 27791 - protein, 170 aa, Candida albicans
LSISHTKRSNNSINNGNTYIKTHVDHRLQYILLIVLIFLNIINVKFATITTTTTNNNNINYIISQGSLINLYKWMKWINRLITLQLLYHGYLMIIVSLTTNIIDQYRGLLFMILPGFNISMPWLFFYWYKHMDELVQQLNELQSEYTNCLNGEAAGRVFNSRRKDLLAGG

SEQ ID NO: 27792 - protein, 241 aa, Candida albicans
LSWLGVVKTGRKNKASISAGTAPTPGALPATTPGTLANAIKTPHNIPTPQIPPQTQSNKNTPSAQSPAYPVKATPSSTTPGTANHSHNPSYVYPTPEIDICAMSSNDSKLAKRRELINIDPEKCFYASLANLLDLDDSIVNNHDIMKTSPRLSNGKPAATSPLSPKTGGEWTSEVKALAITTSCKQVDLIRELANDDFISSSPMLAIQEIEEPQLVKREHDADDDLDSLFTNKNANLDGLD

SEQ ID NO: 27793 - protein, 125 aa, Candida albicans
VVNLCCCCYSSSSSSVVCMCACACVASHFFLPVLGNKIRRSPVKCPPREHPMIKHSGSLILFHMYCCWSLVPMQIINIHHGLAGPRLSESARTSPREEDEGEAKRHKRGGDTQESARKKKSVSTR

SEQ ID NO: 27794 - protein, 98 aa, Candida albicans
YFHCTTDMSTSYVGYILPLQNIPRLSKRFRHYENTFTRSNLQLNYQFQLIPLIYYIPTLMIFLKKPTSISEQNLSCPNTRNTYNAQRRSVNPEYPSNL

SEQ ID NO: 27795 - protein, 112 aa, Candida albicans
RKLRTFQPGGEDQQQQQQQQQQQQQQQQNAQQQLQVPVIPIQTQTSQQMASTTNHKSANLIPGFLQNPTQATGNSANASKLSDAGDGTNPTTAGSSSSADVNNTNNGPNKNT

SEQ ID NO: 27796 - protein, 159 aa, Candida albicans
KSSCLGSVNNVNGLKNLNRFELIKKRDYRINTNQALKFLGEYYMIFENQLLANQFINQTTTKPSETETETETDVGAGVGIIMNGMKINFEIIKLNESILKTMSNEKISDFNKINEILSIIDNPNTGTDFDFDVDVDVFQILNNWLNHNSSRRRNNYVLV

SEQ ID NO: 27797 - protein, 65 aa, Candida albicans
IDSKIITFFCVLCFCTPFVFLLTTTITTTTTTSHVYLINQPQNTQLLFPVQIGFDINTWHTHNID

SEQ ID NO: 27798 - protein, 75 aa, Candida albicans
NNIKNPGIIEFLFREIINNIVFILVLVFQSILSICLHDKQLDVFENTFETIKPPGIHYPLDLSKFVEIHELESQP

SEQ ID NO: 27799 - protein, 102 aa, Candida albicans
RLSTAAGDAKEVTTIEGKTAKSWVTAPGSAAGSVVSETGSASETGSSESAQSTTTGSSSTGSSSTDSSSSSSSSPSSSANFAVLQTGGIGSVILGFMMYLLV

SEQ ID NO: 27800 - protein, 138 aa, Candida albicans
YYEPFRVVNIFIDSYYEPGTITNFLATHSSGAATAGATGTSVASGASGASLEDSTTTTAAAAAGGNGAATIDDTTKGLTFVTSRTLKPSSSATSQGSAQALGSGSNANQANAAGVYSTNSVLVFVSICIGFIGGSLGI

SEQ ID NO: 27801 - protein, 74 aa, Candida albicans
DLFKLTGVRYVSSYIIILDNTTIEQVAVIHIESKFQSNWGLLNNCISFEYISNDDWVMYISFSVVIGNEVRVSL

SEQ ID NO: 27802 - protein, 66 aa, Candida albicans
  UNSURE (28),(59): Identity of amino acid sequences at the above locations are unknown.
HVEIYKLHDPGTRNQSEKKKIKGHKFEXKKPPNKAKEFWRDKKNIECKKSGETTKIKKXEGKILDF

SEQ ID NO: 27803 - protein, 73 aa, Candida albicans
NYIGRLKLKSLIILSIVKHTKTKLMFVYWNGIKFFETTTNNNDNFKRQTNYSVHRELKQLHNFSNQNSEISQN

SEQ ID NO: 27804 - protein, 66 aa, Candida albicans
  UNSURE (3): Identity of amino acid sequences at the above locations are unknown.
PLXLVRIGYSRGEKLKFFCWPQHTIKLSLLLSCLYSYRSSISSRAYKYSIYIKYIFIIKQCWLLYN

SEQ ID NO: 27805 - protein, 195 aa, Candida albicans
RRGCFTRGGYLIQELKVNEDVASANDPETSNESESGDSEDNIYNRLKYVGGRRSLASAKKSKLQDKEVEEDKDIKEPQTFIHTIKLSPQILLDIIEPTSKTFMHTIELPSRRIVHTTKLPRLILKLKKTSTETTKETISTQLPENLELNLESMNLNENGNEPTKRATTANITSSTEVPAAFPVLSQKSPTPAPLP

SEQ ID NO: 27806 - protein, 71 aa, Candida albicans
SRPVVKTIFLTPYFKITHYIYIYISLNNPFYKGSEEDFILSEIPIFSKLMIFVSLIYQHSSSCSYYHRPVI

SEQ ID NO: 27807 - protein, 175 aa, Candida albicans
  UNSURE (10): Identity of amino acid sequences at the above locations are unknown.
KINHIIFLPXNSSNKYQDWLSTISDNSLQALKNYLYGINSKDDSIIIDDKIHAIYKSQTWNVNSGSLSHDDILSDSNSTSMYKVKSLISIEDDEEVKRKQEEIRLKKRNNKRNSSVKSIGSGNNGGVSGFIHSIKSNDNNSIISLGGDNKNKMKNVDKSTKRKSSIWKKLGFLKG

SEQ ID NO: 27808 - protein, 85 aa, Candida albicans
  UNSURE (82): Identity of amino acid sequences at the above locations are unknown.
SIQFSIIFSLLIYSLHHQSISIFHIMSVKEDIPAVFLEKVSPRGLEAIQKTKDFVNDYCLPADQIYPEQGPDSIRHELPIRXQRG

SEQ ID NO: 27809 - protein, 63 aa, Candida albicans
AAGIPCYLFLFSLVSLLVLLYHRYQHELCYIRSENEGAYYTFLLLMINLLLKTTYYHQVLIYT

SEQ ID NO: 27810 - protein, 200 aa, Candida albicans
HKIMIGTKTNEDSASSVVQTAEDLLVEKLDLFISSIESRLDNFERFFKLDKKARKEQQQQKGTINGGGSGGGRPLGRSRRSSSTSSIQLFRDFSINNLNMVYERLRLIKKSVLSNSFNNLEYLSKVLADQYNYLFSSLAIDSDSDNEDDEDLSIDQSKEGLQNMGIRSLNKREILSQKIITTIQYFDEKLIKIDDFIKGK

SEQ ID NO: 27811 - protein, 61 aa, Candida albicans
LMNPTHNLIYSFLFFSFLFFFQLFHIHFTECVKCYVVPGSDTIPALELKLNLSIVDVLDIL

SEQ ID NO: 27812 - protein, 60 aa, Candida albicans
  UNSURE (7),(38): Identity of amino acid sequences at the above locations are unknown.
VIKWGTXYEQHTLHKCNTDFFFFPTSLIECKIQAVDRXTPITTATGIVMKPRINVNLQNI

SEQ ID NO: 27813 - protein, 164 aa, Candida albicans
  UNSURE (11),(20): Identity of amino acid sequences at the above locations are unknown.
SRGQWIFLACXEANLLRMWXEKDLPTVPLVVKTLYNGVYLNEVEYVTQISKSWVFTTNLIIRAEEIFTRNFVESEGDPIVAYHLVQVLYYFVNSAIAYMRLTPENKAHLQDYQIWYNNRKQYWIGVLLKAGLEKEATEIAEKYHDFASLARILDIHQEETNSTD

SEQ ID NO: 27814 - protein, 81 aa, Candida albicans
  UNSURE (62),(71): Identity of amino acid sequences at the above locations are unknown.
ATIGSPSDSTKLRVKISSALIIKFVVNTHDFEIWVTYSTSFKYTPLYNVFTTNGTVGKSFSXHILNKFASXQAKNIHCPRE

SEQ ID NO: 27815 - protein, 188 aa, Candida albicans
  UNSURE (78),(184): Identity of amino acid sequences at the above locations are unknown.
STVSGTDLDPDEMAPALSQLMINDKLNYKKSNSPQRSSSLNVGNSTKYNKTSNNNSNKTNRVFELETSSTSVSATATXTPQRIPSVRSRQSSEAYDFDLEIGMSMAKLLKNQQDFPSSFESLNASVSSPVFTTLGVDTKDEDLLLSINSSPCDTTKSNVIANKQLSHPENISTSSPRELAGSAXYVSE

SEQ ID NO: 27816 - protein, 67 aa, Candida albicans
  UNSURE (6),(7),(9): Identity of amino acid sequences at the above locations are unknown.
TRVIFXXLXRSLLHTRVTNGPYAARINCSHLDVANGLYESLRNSVTQVFTPAHFQRSDEWNRKFVDD

SEQ ID NO: 27817 - protein, 62 aa, Candida albicans
TYFAKGELLHKSITNSRIISSHELYLFDNGVLIVHEHTTKIEKKNKKIVYLGTLSSFWFDNV

SEQ ID NO: 27818 - protein, 166 aa, Candida albicans
KRFQTLDPSVATELGVINQYQNLESSELLQQDNASAITIEEIDDSDEEQERSNLASQLRPQFSNKPEIIEPTVASEENTEKSNPDHDNSKIESEDTLLAPGASSNVSSKSSLFSNDSQKRPIKSALKSASSFTAPTQQQQQLQQPAAIGYAAQQAYLSLTTAENTR

SEQ ID NO: 27819 - protein, 86 aa, Candida albicans
PKRVSCQLRGEDDLFWFRFQLSKFKNNQILNGRIAKPFLSTLDDEKSTGDFNQAGHLNSSFAERSSVSDDEKDSRLWIQVLRQNLV

SEQ ID NO: 27820 - protein, 144 aa, Candida albicans
EIPIFFFHQLHIHTNMHFIFYLILLVSAADYGNFGTYPKVPKTASINGFADPIYDLLPDCAKECVKFSTSNTPCPYWDTGCFCVMPQWAGLVGQCVAQKCKGEDVASARFLATSLCSVVGANTWMMPASISSSFLFTTGAEDPR

SEQ ID NO: 27821 - protein, 209 aa, Candida albicans
  UNSURE (15),(206),(207): Identity of amino acid sequences at the above locations are unknown.
LMCSEMEQFLEFKNXIENFDKASRLLLSKKNKSIQEFDDLISLGESFGLDIPSLNFIIRIRDRLKWLRTYSLIEKGVDPYGDKNEVFSIVDLRKFLDQGISVLSTDDLPMIKEVEAILNASNAFDHEVSKFLKYNYVQELDLNRLGDIAKRFSTEKLFISMNNYLELSKLHINIKLIEQFKELESASYPELKQLHKSCPRVEIPLXXNP

SEQ ID NO: 27822 - protein, 82 aa, Candida albicans
RIYYELVSTESHSRSTSYTTTQLHEMSNFNSSANDSTSTAPTASTTTNGDIGLNFASPKKITALEAYTPEYSARRWKVPHLR

SEQ ID NO: 27823 - protein, 110 aa, Candida albicans
  UNSURE (77),(94),(100),(101): Identity of amino acid sequences at the above locations are unknown.
EQKVSFSISEVDKDSLEVWISFPIFLKLSIFNYITYITILSKKLSQMALAKSKLLTPGTAILIGGVCYGSWAIWMAXNYFHMSSIRKVYVDSDXEYDRIXXIAKNKYEGD

SEQ ID NO: 27824 - protein, 73 aa, Candida albicans
FVVGATSCSPRPVSLLHGVRWGGILGYKQNRKSILLGRPSPKTKTKITLFSSFLLFKPFFFSQMVIKFYSVDN

SEQ ID NO: 27825 - protein, 86 aa, Candida albicans
LKIDSFRKIGKEIHTSKESLSTSEIEKDTFCSYLYMTLFLLLLLSCLINNYISRNMYVCTLFLILRDIIRGVVKNIVFCFFVFPSV

SEQ ID NO: 27826 - protein, 72 aa, Candida albicans
  UNSURE (48): Identity of amino acid sequences at the above locations are unknown.
RFAVSILATVMLIAIGILIIQGALEQLMYHPIDESSSSMMNVKDVDVXAVAVVEVDSVDVVAGELAQTPVEN

SEQ ID NO: 27827 - protein, 311 aa, Candida albicans
  UNSURE (96),(306): Identity of amino acid sequences at the above locations are unknown.
TFNWYYTELILPNSNLELGNQPANLNISPRKIISILRIYLNLLELFDNGLIIIRRKPGYIAQCITQQSIIPNSPQVFGPIHPQQHQQNQLQQQQQXQHQHPSHSSWMMNFHQLGGTLAVPAHPELLRSQSQSALPLPRLRQQTFTPIQQNQQVQHQHQPPQQQHQQHVQPQYNYYNQQSIQSQPHSVRPYSQSYNIYQQQQQQQQQQAQQQAQQQQQQQLQYQQGHQSQVSTPTLNSSSAAALLRSSSSRSFVDVRSTPPTSSFAQQQQQQQQQQQQPPLTSSIHDSPTPHPHLPLQQLTSRAARXKKMGV

SEQ ID NO: 27828 - protein, 178 aa, Candida albicans
  UNSURE (145): Identity of amino acid sequences at the above locations are unknown.
RTDELGIHHVKLNCNNNPISFLNKPNDLNKTQVEQILLRNLQASKLGNFPVNLQRLATIDKFTNYNPDLFIYVESIALLFNTIFEIEQQSNSSNWEIENGLSSSIGKVNINNEDRLGVTLDFWQDYRFINHEYEIVKNQSGLLVXDYYTIQVDIVEASKQTDYLLDNQVQEWDISMSK

SEQ ID NO: 27829 - protein, 144 aa, Candida albicans
GLGFSSRLGKSYMDNYNGKFFSNKLILRVSSKKMCDSLVKSLEQEYFKLDFVLLAIIKLISWNVRWYQYVPDYLIMSILQKLIAKYDLVYIMTTIKIIFEQNKRQKTTKSLFGKKKKEGPYEFVESDTIYDYMDYLVNWIYSIS

SEQ ID NO: 27830 - protein, 85 aa, Candida albicans
NIFGVRLVEINNSLKLKFIIFFFSTDNLHINRLKISNNNIRRIIIKQFSLFFFSISSSSSLYNPLVLVITVKTTTTITTIIMNIL

SEQ ID NO: 27831 - protein, 110 aa, Candida albicans
  UNSURE (96): Identity of amino acid sequences at the above locations are unknown.
KEITALIAMCALAYIAIDNYTERIRLEKLHNETSAMNLKALQIQQLNHPREKKQKDVTLLQERREIAKRDFKMSVHIAMLRKQLMDLGVSPIELDXAIKEFEKSVKLDNQ

SEQ ID NO: 27832 - protein, 199 aa, Candida albicans
  UNSURE (155),(160): Identity of amino acid sequences at the above locations are unknown.
DFYPWGRPGQVTIKREGRFKIQLATRKSVIAKVKLETEHKPLKISLKPVIEAKQKAASAVHVDPVIPTKVTFKLPGHRLAGFAKKVELDGTLVTIKLGRDMKSKVDALAHRYVRINTKMRKIDVSNVPFIEKEKGSNTSGVTEVSRNTGEKEDAXSPSPXLVKKEKKRPTVYIHFGGNVKKPDQRIINNSSKEGSTEVK

SEQ ID NO: 27833 - protein, 167 aa, Candida albicans
LIYIHLSLENHLRTSQNMARKSEISISDRGARRRLSINITNNLPPSSSSSSSSSSKEINLGEDELIQTYVDQNRILAKRNAIYSTKITELENKLNQSNLENTRLRNTLLSLVTSIESNVMTNVNNILQLIQQSRITNGLPRNAQLDCLGQLERPETSTPLNSTSSTP

SEQ ID NO: 27834 - protein, 163 aa, Candida albicans
VPYRGPCRPVVKTQSPPNSIPQYQDAMNMGGYYQNYGQQNLPINQSQFPNPTGLVTNVPLPTGSNNPNDTINRPEDESSDIEELSKNEFNLQKEQKPKEVYYTMDELKSKLNDPYSLVQLKFEYYTQLSDHIIKKAHSHVAKNRDCETMRTYHKLIKLAINCL

SEQ ID NO: 27835 - protein, 69 aa, Candida albicans
CRKIEKLSNFIIFCQTVCNKEQTTKKKKQLDIKLDNSTSSFIPKIYGKNKREKECSDWKTIHNYFISFS

SEQ ID NO: 27836 - protein, 64 aa, Candida albicans
VYVFYHLYPLSYTNITPQTMQVTTFLVIAANLVTLVTSSPLTFVSSTYYCLPSPTTTISAHAGL

SEQ ID NO: 27837 - protein, 108 aa, Candida albicans
HLFHLLIIVYHLQQLLSVLMLVCDVVFTSEGYTTTVPFEDCPLTSVSAPPGFPPRPYGGCTTYNGEAYCAQGNCDMFYVSYYHTFFWVTSWPSPNPKSLKRFFLFIYY

SEQ ID NO: 27838 - protein, 170 aa, Candida albicans
QLNSINEKEEKKKGGPKGKKGRKRSSKSSNKYSSKRKKFKIIFKRIRNIISHSNKKETKEKVKKKEKQKREKTKDKKEEEEKDRTRRRRRRRRRRRRRKTETTEKKKRDQKKKKQKETREERGQRGREKRKKEKKENKRGKKKQEKKKKEEEGRTEWSDLHQAEEAQRAE

SEQ ID NO: 27839 - protein, 128 aa, Candida albicans
SSSKGEKIRRKNQNQKEKEARKEVKKTQKKKKEERGKEIKKEKQKSKKKTKQRRETEEEKQSTNQKTKKKTKKDKPQKEKRRKQRTTERIKAQVRPKEEKTKPIGSREKNKKGERKEGKRKKTREDTI

SEQ ID NO: 27840 - protein, 159 aa, Candida albicans
QVAAGGTVYNLPNDSHRLHKSPKKLSLLHKVQSFANISKYDSEENELIKEIESLESLKNTLYDDLVKLISKYTLQNDQYNVSLERLLYWGNMSLAIYCVYRIINVFLVKLPLLLFYGEDYYNVSSTVIDSNEEAPSSKDALAITLSKVILSVFRNLPVF

SEQ ID NO: 27841 - protein, 62 aa, Candida albicans
RRVSSSSISSSSSNQQRNNKQYARNGKQKQMQKKKKKKNNLTKLIINHTHIMYNLLTHSHLI

SEQ ID NO: 27842 - protein, 114 aa, Candida albicans
RLPKDVRNVVTAEQSLYPSEIEDEGEDQEVLDKESLDKVPQPYSGEEPSTNNNHDDNGFSFGFSDSDEKDNHTDHDGHKDHDGFDFTNGASEKPKNNLPYPFKEKSDTVFEFHF

SEQ ID NO: 27843 - protein, 80 aa, Candida albicans
KPKRNKVKGYALVTSSNIGLRSNFKIYVKKPLFKMNYLPIEHINNQQIYVLKHIDTLILDLLRCIEFSITHNTLKSESKK

SEQ ID NO: 27844 - protein, 67 aa, Candida albicans
HMSIIVIRKCAYQDNLQVIGKICLLLNLQDIVQSINSSSRTSRHRELKTLTGILQIKVRKQINITWA

SEQ ID NO: 27845 - protein, 86 aa, Candida albicans
ISWMYDSVNWFDKILINIDKLELAKNQFITALNKKEFYCRSSILDNGNVDESKLAVIITIINQNKNKSIQPIELRFEKLLSEHLNQ

SEQ ID NO: 27846 - protein, 64 aa, Candida albicans
LEVNRRIPWDKERKTPHETLILVPLHYSGRACLSPNLEEQHKILGYHPTKYLSIPRINTDLGRY

SEQ ID NO: 27847 - protein, 168 aa, Candida albicans
CGSFQRRALNTATDNYINVFNTHFDHIGQEAQVGSAKLIIDTMKELNLWPSFLSGDLNIEPNLDPYKVLNNYLLNTANLATPFNKFGHFKSTVTGFEREVLLDGGQNIDYIFAPKYTLKMDSDENTKGAGELTTDISLKLYQLGMLHSKFNGKYISDHRPLVADFIMN

SEQ ID NO: 27848 - protein, 108 aa, Candida albicans
  UNSURE (83): Identity of amino acid sequences at the above locations are unknown.
GEAPEQVGGDRGQRGTPAGDRNRSAGSDVQSRSSHVPERAGDHCGHGCLTERIKWTGTKPAPDRLGGRPENGRLRDEIMGDVXGYARVSTGDQDVAGQTLRLERAGAI

SEQ ID NO: 27849 - protein, 78 aa, Candida albicans
TRKRGKSRCVVLQEQCRMGRGENEKQTRIVVEDMKTGLIRTREIVEYRSECHENDRRDIERRIWTEKVERSRKPELEV

SEQ ID NO: 27850 - protein, 67 aa, Candida albicans
VKNKKTKVYVKGKEKINKLLGDMERGERASSVTKIGEEDRVFEENIIMQGIVGQGITQSLIYQEDTV

SEQ ID NO: 27851 - protein, 236 aa, Candida albicans
RSLAVPTTSSFLQNNQSHLIQPAANTSVGPIPESTALGPHVNIPQANQLQQDQSSQALVGGLPPSQPQPQPQPVIAQQIHTIPENQSIAFDMTQPAVANAHLPESKPDLSETANLQRDLNPTADTTTNTTTATKKRKNDTAGGTNKKAKVAKGKKKEPKSKSKGKNNQEDDQNASNKPDDENVPGKDNGNEENHKVEAESKEEHLQMGMKPPQPKQIIPVIHPTGTTTTTTSKSKK

SEQ ID NO: 27852 - protein, 195 aa, Candida albicans
STMLVDNYIKASSIKFNISIAPCVEIARYLKSNQQQQVRLQPHEDPKQLLSHQQQQQPDTQYHYQNHHHNKQYRQRQRRQTQEHKQQQGTPRIRRPSSSLSPLYSPKTKKSTPNKTTKTLLHKSSTSPTSPPPPKKKKSKNRIIVPNEFINCDLDIIITLINRMLISLIQLNELYFNNNHNYHNLIYPTPTNSFP

SEQ ID NO: 27853 - protein, 101 aa, Candida albicans
INEINIRLINVIIISRSQFINSLGTIILFFDFFFFGGGGEVGDVDDLCSRVLVVLLGVDFLVLGEYNGDNDDDGRRILGVPCCCLCSCVCRRCRCRYCLLW

SEQ ID NO: 27854 - protein, 65 aa, Candida albicans
TIVSFKIGNNDNTMPKSPRIGYGLINEIQQRHKITAKNESPSKDVILLFLYWKNRIVNGNMKIQV

SEQ ID NO: 27855 - protein, 124 aa, Candida albicans
RTNNNSSNDTSFPTTNSTVLPSKRSSICISHRIKSKRNSSTSSTTSSSSSSPPPTPTTLTSSSTRKVVTRSQIRRSNTISSASALRHSLNVSNSNTIPTSIPKKLFSLPIHKLNSDSTLNEPIG

SEQ ID NO: 27856 - protein, 129 aa, Candida albicans
MNQLDDIPHFYNTTMDINGAGNKYYGVISSTNNLMGRDGLLTLDLTTGNDTNSLFTTATKEILDNDLIIMDPPEPEEYFRRTEHMVRYGYGYELTNNTAVAGGGRELKYPTLARSNVQNWKKKNCPDSV

SEQ ID NO: 27857 - protein, 120 aa, Candida albicans
IGKLNSFLGMDVGIVLLLDTLRECLNALAEDIVLDRRICDLVTTFRVLEDVSVVGVGGGDDDDEEVVDEVEEFRFDFILWDMQILDRLDGNTVLLVVGNDVSLLLLLLVLHPRALAGSAL

SEQ ID NO: 27858 - protein, 120 aa, Candida albicans
  UNSURE (53): Identity of amino acid sequences at the above locations are unknown.
ISLIQDLLTVETTITTLKEFGMSWLVSEWRFRRVYQLPKKNLFDIYQTVPEFXQRTTLPTVLITGPNPLLSPASASTNTSKSKTDNFTPNGSQPAKKPLEKLETNNEGTNEVRFISVKYY

SEQ ID NO: 27859 - protein, 169 aa, Candida albicans
  UNSURE (167): Identity of amino acid sequences at the above locations are unknown.
QDQIHCCLQQVQVQIQVNQKQTILLQMVVNQQRNHSRNWKRIMREQMRSDLSVSSITSNGSSSGLMRRGSISSPIKPSPLSLPQNGRNSPRTSRPNSMLFLHPNSSTSNLESDPEKKSSAPLSPSTGPGAGTITRRRSNSQPIGRDAIIATSGAATVFTTELAGSAXHV

SEQ ID NO: 27860 - protein, 194 aa, Candida albicans
  UNSURE (186): Identity of amino acid sequences at the above locations are unknown.
INEISLNQIDVAVAPNDFSSPLSARKPDIFAAITAANGNSNNQFKRPHKLVSQSPSPSSKNKFRISSSTTSSPQSNLHSPSKLGLKGFKMFKNANRDAIMSSSRVMTPEKPKMVSKIFGKSAKIRRAYTPTHTSTPMAVSSLNPPSSSTLNSTTAAITSTSPPANEHYDIDNDFDSPSKNRKLSNXSASSIIIY

SEQ ID NO: 27861 - protein, 74 aa, Candida albicans
ARLIFADLPNILDTIFGFSGVITLLDDIIASLFAFLNILNPFSPNLEGECKLDCGEDVVDDDMRNLFFDDGEGD

SEQ ID NO: 27862 - protein, 60 aa, Candida albicans
  UNSURE (38),(56): Identity of amino acid sequences at the above locations are unknown.
TTCVPATYMELWRVLFEEALTSIDGKSRPDSTEHWLSXLVNTNGEEIVEAIWTENXLIYL

SEQ ID NO: 27863 - protein, 65 aa, Candida albicans
RYKKLSWCPIDVRLVDIQITRNQFPELNGLYVNCLGRTPTCELVGPSAEETNPGKCNFSRLQKFL

SEQ ID NO: 27864 - protein, 63 aa, Candida albicans
SVDLPAARRILVRLSKLQVEVLIRYKLGRAKILLNYSSDQPGERNSLLCLNKLLIAQLDPYIP

SEQ ID NO: 27865 - protein, 206 aa, Candida albicans
PRDTCRLGAIFSFAKKRPSEVDVGPWTPTSLSASASASFSMRNRVPSSSSLTGTSFTNSIKRNNSFSNRKSSLTSLMQRKNTLGTTPTTTNSLTSSNINILNQRFSQPTYFENFGNNNSGPQSPAISRHNSTTTLMNSNQVILENVNTPGSYNSTNSFPSYVPHETPNSIPETPLNVKDLLPSSFNIRSSQMSTRLDRVLEEYRAS

SEQ ID NO: 27866 - protein, 109 aa, Candida albicans
VGCEKRWFKILIFDDVNELVVVGVVPRVFFLCIKLVSDDFLLENELFLFIELVNEVPVNDEDDGTLLRMEKDADADADKDVGVHGPTSTSDGLFLANEKIAPSRQVSRG

SEQ ID NO: 27867 - protein, 77 aa, Candida albicans
KSHHLIKLSKGNPSDNPPSYNESISQVSSPISLTPVSSASRVPTLSNSNSNSKARSSKASTKKKNVPYKPSAVTTTT

SEQ ID NO: 27868 - protein, 230 aa, Candida albicans
KTNKFKNAQDFYDHIQPIPFQTNTVPKDRSEIRGVDSSIHRFLFNKFKWKEYPPILKNEFMMIQFFPHHHIISNFRKSNIAFAVNIYTIPLFNSIRLRDAMNRYRGRYSNLQFFKTKTLPIQSACGRSQTKKLFRELFVKALQTLGVINKEGNDNTSVTDKLKGVYAIHIYKVPITTEQKDKVVQDYSAMINKIVNDKNIWNTLNQAARRSKSVNLQPVFFTTGLDGNAL

SEQ ID NO: 27869 - protein, 193 aa, Candida albicans
DVAIKFLVQRHRRMDAFGYDYIWCDCTGFKITLNNLKIAINRLHIFPHIIHFEYINDLMDLVHSYPDLGRRLLKINGTFNSFDFQNLENLMTLMDQSQIRFDTLALSNFNYSFPLPPIATNLSLFNCLVADYMIQGLRKLNLVIDHPSIQDRIVTFPDSLEELLIDTSVNISVIPSPSLRELSLILRHGSKTA

SEQ ID NO: 27870 - protein, 112 aa, Candida albicans
LENEIFVERGNYQDKVAQLMTFSHYLYNYLSQYNEITFNNYTGCENRSPYEPHGVERKGEKNILLPINAAVIITSKELLLVWVWFGSFLTRNFSDKMQCYCNWFYLIRCEFN

SEQ ID NO: 27871 - protein, 63 aa, Candida albicans
MLFLKPMTNLNMVLKMSRLKLLVFMMVPSLLILLKIQVFNMAYCWIKPHSMLNKVVKNMILVN

SEQ ID NO: 27872 - protein, 60 aa, Candida albicans
CATVHATEIPAKRSPQTHNLKENLETVISEIAEIPKLVFLIQHVRFINNHHPKTTVSPTG

SEQ ID NO: 27873 - protein, 63 aa, Candida albicans
SLEGEKSELRKFSFSLDCNFSKLFDNLGLFKEHQPPTANNPSTLKLFNTIDYYQKGFYKLCAL

SEQ ID NO: 27874 - protein, 140 aa, Candida albicans
LQLSVHSPYTYTMFVSIKYDPERFKSLHSSANTPHTGRTTRRSSMPDYTITTIALSTKYNTNTITSNSQSSSFTLLPTKIVKFKYNSRRFVNSPASTNSGILNNTPEFKPDINNKSMSTSPTTGIQSLNNADKNFAWGNM

SEQ ID NO: 27875 - protein, 82 aa, Candida albicans
SIVLNNLSVDGLLAVGGWCSLNKPKLSKSLEKLQSSENENFLSSDFSPSNDQNKKENRHTILLIRLEFQSINTDKHQQFKEL

SEQ ID NO: 27876 - protein, 79 aa, Candida albicans
KNNKEVMKKNRRKKHTYRKSKRKLKNNQGSEVVKEAPPQEKRVINQSEEMLQELCHHYHHHHHHHHRHHHRKTTNTPSQ

SEQ ID NO: 27877 - protein, 123 aa, Candida albicans
IKVRKCYKNCATTTTTTTTITTATIIEKPPTHQVNDNEIKELPQVDEEDDPNQDQEEDLILLEECLEHYFNNSISVKRELERRATLSHITEGVTATNLNDDGFSSICSSSSFFSSSNHYTNVK

SEQ ID NO: 27878 - protein, 64 aa, Candida albicans
CLPLENQVTVFFKRASSFIQSSNKRFVLSSNNYFNPNNVATSCYCFHYQGFSSSCNYYYLCCFY

SEQ ID NO: 27879 - protein, 101 aa, Candida albicans
  UNSURE (91),(95): Identity of amino acid sequences at the above locations are unknown.
YLIDAFPLKIRLLFFSKELHLLFSLLIRDLFFPQIIISIQTMSPQAVTASIIRGSQVVVTTIIFAVSIKALAVLGIYYDKSKPTRPSQFFXGPVXKIHWRE

SEQ ID NO: 27880 - protein, 67 aa, Candida albicans
QNKKFLHKTVCFFCKFRNCVTFFRIYNCVKIEEEQLIPDCQDSLKLLFKSHRLILQYMSLLYDPLTF

SEQ ID NO: 27881 - protein, 62 aa, Candida albicans
FFIQGSHFINTHIYIYNQETMSTYRKTYKNQLKRFNNGNNSNSTSTELTNLVEMFPDWEADE

SEQ ID NO: 27882 - protein, 61 aa, Candida albicans
QGLLSENDNSLEIVIDLIVNNKVSKWEPIKKEKHKKKEHKDDTTDSVSLHHGIDGPPKVGE

SEQ ID NO: 27883 - protein, 194 aa, Candida albicans
SVVLPPPGEDDDELYELDRFELFVEEQMPEDEDNGDTHSDSPGNELNGGAHHNSQEQSDRLIGSNSPTNKPHNGNNTDPTLRFRQLLTNTKDAFLTLTDNIIAAGFAIPRSVSVSTQSLTGRYRNNSTARTEYTKEVVPDFSPEMFLQPEGSSHITETLSEQNAAPLTTNSNHRRRNVYVYSRKEVILDVSSDE

SEQ ID NO: 27884 - protein, 88 aa, Candida albicans
  UNSURE (49),(51): Identity of amino acid sequences at the above locations are unknown.
LISTCNEHRFVRRTMWRTDKKFFLFCGRWMKNFVPINLFERWWGKCGEXKXSADAQTNFIISHSLINYSFPIMHKLFETQTYNLEFLN

SEQ ID NO: 27885 - protein, 190 aa, Candida albicans
  UNSURE (2): Identity of amino acid sequences at the above locations are unknown.
SXTLSCLRLVKTMPKGPESDIKETTTAPVPVPVPIEETKAEPVVDQTTAAPIPVQETETEPEPVVATSKDVAPADYANEPIDTTEEHPKTLDPNAVVPDSEAKEVDASPVVKESRNTHETAQDEEEIIIAAEGSEKDITAAVEAREGAGVTLEEIQPTQSEKERLTREAKLAAGVDGPVTVEKINVPEDE

SEQ ID NO: 27886 - protein, 66 aa, Candida albicans
ESLHLKMNYPPIVKSTSPNDRHHRVLATPYMMVTTTTTTKKIHYLDGIISSVREAHDKIYQFPFLG

SEQ ID NO: 27887 - protein, 65 aa, Candida albicans
  UNSURE (54): Identity of amino acid sequences at the above locations are unknown.
IPVGSVYLYLVSFDFFYFLFQYEIFKHLLLGKEKTTKILILKQKYLEHSNRVLXSEFGKSAQFLV

SEQ ID NO: 27888 - protein, 157 aa, Candida albicans
TDLTTRCNVYFQQLLTQENFQINYHDSGYKTEPFVYKRKKWLKERIRSLRKQYKFDKNKDKYDFDQIAKQEFSIVSKNQSIHELNIYQHFCHTRIFGKCFDTNNNNNNNNGVINMENPQSNQLCKSFVQKLYPWMSGNLPIFERNKERSPPQLDDYD

SEQ ID NO: 27889 - protein, 84 aa, Candida albicans
LWIRMERFNVEQTLNHFWFNEKEQDSLDNSEGAEESQIVEESSCFSSSSQPSSMINGTKRLMIRSNTQPITLKEQHESQINFKT

SEQ ID NO: 27890 - protein, 147 aa, Candida albicans
HRHKYNDYAELITNPFGNPSSIYSGSVDDFSRPMKTDYTDEGINPLYSQIKPLKKSTTEPINSFELSYQTPPETKFKRSFTDEYPITEEDRLHSSQDESKVNNQEEDQQQGSPTGTDIIDDFLEELNAPPEKEPPYPVRGVSKYFET

SEQ ID NO: 27891 - protein, 73 aa, Candida albicans
  UNSURE (18),(38),(62),(68): Identity of amino acid sequences at the above locations are unknown.
CYETSRSVDQSPYCCVHXTHICVLSVYLVTVRIRCSHXAIVPAVTSLSHELKLCMSMSYYIXHPDHAXQLHIC

SEQ ID NO: 27892 - protein, 94 aa, Candida albicans
  UNSURE (18),(54): Identity of amino acid sequences at the above locations are unknown.
ASYAYSNKIDRQNADMCXVHTAVRTLINRSRRLVTSRKRSCHRLSISTEQLDRXDLWLGRSYNTDTCVMSRVREHSDIRGQDQQPSRTIQNETR

SEQ ID NO: 27893 - protein, 60 aa, Candida albicans
TKEICPERRMIKMCEKLSRNAKQTHVRFTKNDWPMIKLGGRNSERSYKRDEHGSRPHGVN

SEQ ID NO: 27894 - protein, 102 aa, Candida albicans
  UNSURE (2): Identity of amino acid sequences at the above locations are unknown.
SXTYSTYTTTTTTTTSSSFSSTGSINTILNWFLELTFQQLIKFIYQLSCFSFKFYLMYQFILYELSINQIGFKKFINYQEFYPKLKEQDEEDFHHRPEDPRI

SEQ ID NO: 27895 - protein, 79 aa, Candida albicans
LKSMRSFIKSHRKTDSTVSSTLESPLLENNHATSTHGHSNSATLISPPDDYYPPVSYSNRSSTTPILPRSPHHGLEGPH

SEQ ID NO: 27896 - protein, 126 aa, Candida albicans
SHSQISDVLNSLPHIFMGCNVKEGNLLDRSPFDTKRDVKIGGNYEIYFTEDTVFYHLQNSDNSDNSGSSTSLEINIPHGKITFDRVNDITSLGLLIGVLMILYAISIRVFMSTTSKTKRDSQLKKK

SEQ ID NO: 27897 - protein, 65 aa, Candida albicans
IPQHAVIRQSRGEDEEEEEEDKNAITTTTTRRLNIINFLKSDQFKNMLMILVCLIIIIIDIIQIK

SEQ ID NO: 27898 - protein, 67 aa, Candida albicans
FIFQINKLRNPFKITKQIVELKLQERASVEKLYMSLHMSLYNGNHFICMISIIIMIKHTKIINIFLN

SEQ ID NO: 27899 - protein, 135 aa, Candida albicans
  UNSURE (133): Identity of amino acid sequences at the above locations are unknown.
NIINQLHIYPPLPLLLLPMFARSPFISTIFKRSIGSVRTTIIGTGTTTIPKQYQLFNFNNLITNFKSSSSRSSYGGSSNYSNYSSSNNSNNTLKILFASTGSSFLLLSTFARKIHNDTGSSTQFRYRRAAGYXNA

SEQ ID NO: 27900 - protein, 128 aa, Candida albicans
QGFFNQYYFGLLWQLMETQAKHYKTSTDINDFISHFVQFLTVKVPEILIHDERAINAIINYNVNLLLNSPFINRAVESFNLQTDNIYGLTLVVRELMKFDDVRFSVQLSLYKRIVEFETLVIDEFEYS

SEQ ID NO: 27901 - protein, 67 aa, Candida albicans
YSYIELTPEMIQFLQDIKKDIDYRLIKLQQQSVVNGQHHVLSIYDNESLASSTSTSTSTDIPSELTC

SEQ ID NO: 27902 - protein, 64 aa, Candida albicans
VNTFTHTHTHTQLTLIITLFLSTNQYQQVLINNNVRIHIYIKKLDCKPLKERGVVPISIELESC

SEQ ID NO: 27903 - protein, 62 aa, Candida albicans
QKHNDNLTREQRQMGINFFQENLDDSFGGIRWKERPEFKGSISKVEIKNFFWWVTLFAIKKH

SEQ ID NO: 27904 - protein, 177 aa, Candida albicans
KTFFGGLLYSPLKNINPESENVDDRTSDVLNRYGSDFVNVSKRRTPLMSKTRSDITCSSSNHKKQTNEISQLQRAKSGDVLKVKSISGSITDSFQNTLNNWINKFETDPQDDQNPNLLPDTVEMNKSIPKISTPPNPNTSIQSEDPFSDDDDLIQLLHSKTLPECPQSVFTRAGRSR

SEQ ID NO: 27905 - protein, 71 aa, Candida albicans
TNLLKSRVGKKRERFHRQKSGFKDLEGEPLNLFREFKNPSIFPVITLNIPPNYSINYSKVPGFRPNRYKFR

SEQ ID NO: 27906 - protein, 208 aa, Candida albicans
  UNSURE (132),(184): Identity of amino acid sequences at the above locations are unknown.
ITTTPNFFSIMIPLKQITWNKNSIFQNTLILSKKNLSKNSLLLSLSSSMFQKPHPKQILRPPQNKSQTPSTNPADILKKNDILMYSTKPTNYIESVTKNGFHLSNNLLIESKLNKIPQIGTLNATTTTSASXNDSAIGLMLLQSEAFEIKLNSNTINIIDDWYVDFKINTSSSSSSNDGDGDSXIKIFELIHPKTEILIVGLRKKSRM

SEQ ID NO: 27907 - protein, 61 aa, Candida albicans
KIIIINSHPKQQKKKSQKKEKQDNSQQRKKTHQKKNSNSVYLYTNKILKPIHTHQSSVRFQ

SEQ ID NO: 27908 - protein, 92 aa, Candida albicans
LYSPPPCAHQLIILLSLLSSHRIAWLHFHMSIIIVFNFNFFFTIIFIPLTSIDSSQFISVPNFTKLLLFFGIETNHLIFTTRLEGSGHKVGE

SEQ ID NO: 27909 - protein, 64 aa, Candida albicans
FVDGSVVQETLGVGPIKVPKTNYRLNKTITNLIEQFIFFPLQIKLRRICQNSNNRVLFIVSLLI

SEQ ID NO: 27910 - protein, 60 aa, Candida albicans
FPPPWDSGRNFWVNTSFAKGGRNVEHAVISRNLPLWQQSGATERPWNGPDSHREEVINTG

SEQ ID NO: 27911 - protein, 92 aa, Candida albicans
KYLIILSISIIQQRQQQQQPLSSIQFNSIQFKSSQFLFYLLNTIYTLLQIMSFQNFDQIINLKVKIITLLDQIIIGQIYTSSPTGAGRSACE

SEQ ID NO: 27912 - protein, 157 aa, Candida albicans
  UNSURE (32): Identity of amino acid sequences at the above locations are unknown.
LAAEPVSKYFSWGKFEVMFNFVIFIGRADLRXYRPNRLPKKVRAIIIGEQTAVVISFESEEENDDDDDGEEEDYEEYTDYEDGNQDEYASEFPDDELYFKNSTVGRESDSGLTPVNNTNFEKNYSTDSYGYNTPNTFLQSPHVGKPKPYPDNDEFKF

SEQ ID NO: 27913 - protein, 68 aa, Candida albicans
LIITTSDIRNDLIQSFSLSVGVVWYYTKRLKRLVLEITYHGSSLKFQFYKQKNKKNKKKINNIHQGVP

SEQ ID NO: 27914 - protein, 98 aa, Candida albicans
NPLTKKKKAINNNEIIIYATTKNHTNNKNQKESDKRKSSSATTTSGVTAGTNNNKKQKSSSTSTTNNTSGNSGTTSNKSKQILSRLNINVPAELKHIL

SEQ ID NO: 27915 - protein, 191 aa, Candida albicans
  UNSURE (187): Identity of amino acid sequences at the above locations are unknown.
TNQVLSGSAYITKDTKYAKITLDAKEPIQDKKEMDKEKSESSSLSTPEPPQRRTRSARDTTKSKRNLRDTPKEKSQYNDEEITLGGAEKSKVEVSSTSDHTDDQSPTPGSTKKGLDEQTNDDMSDIEDVDKDKGDETIAKIKKENTSEQEEDKNKKQTEEEAEEEEEEGDHVSGDERESKNMPDHGXDRSA

SEQ ID NO: 27916 - protein, 190 aa, Candida albicans
EDEHEHDDDDDDVHQHRHGNIDRYCFHFKYLFPFHSNLTSLTVDGVNVVNFHNFDNLINLKTLNIYNQFKSCHKTFDYKLPISLTRLIFDHCHYQQYLIDNSTNNNNLYNLKYVQITNCGLNNIDQSILKLPDNVEELNLNNNCIGIIDNPSNQNQNQYQNQEITIDKIFPKNLKTLHLCYIFTTGGRST

SEQ ID NO: 27917 - protein, 144 aa, Candida albicans
GDNSPAISFGILHFKLIHSTSASSASSLYIHLVMYGLRSSVKNLLTHRYYYLGGGGSSYRINQRSFHQNRILRKDEKTKELLKNLGLNLQKGTINRSNKTKDNNNNKSGSSVKNEKTNDNGDENEGNEGNVTRINIDQRAGRST

SEQ ID NO: 27918 - protein, 78 aa, Candida albicans
  UNSURE (5),(10): Identity of amino acid sequences at the above locations are unknown.
LARRXVVSLXEHVRMSLNNCSLKSNDNSSKGLDTITLVPTFQTCFASRLYYIKMTVRLNHGYSLLVNVPLNIHTYYNF

SEQ ID NO: 27919 - protein, 203 aa, Candida albicans
TRIFLPRGQTPEAIKITGVDNLSTNDIQNYVDYYINYTTTIINPETNELKYELVPFDQLIEFKIEWIDDSSVNIAFKTIDDCYKGLQKISESPILEKLGTQEYIEQSIIERKGKSYNPIIDFKKHQNLANRLKLANESKNTDNNEVKTEELDSGDANGVGASTGDMEEDEVSVELIIRQSFQLDRKVKNASQYSRYYLIHGEP

SEQ ID NO: 27920 - protein, 133 aa, Candida albicans
IMFLRYFLVAKIITKNDGGVFNKLVTLVNQQRSFAFKPTAVLFKSKKKKNKQLQIDQLTNALTKTTTQLATQIETIQHNQQEKQLQQQELNDNPKVESSPQTSLDSLIDLPFVPSSLNYLSSSPTGLRRIRAY

SEQ ID NO: 27921 - protein, 65 aa, Candida albicans
LRNCRNNEFFYHKLNVSHIQSDTNEGYLWFHPTVKHATQWSHNVNSKEKSTFSHQALPVKTPLTN

SEQ ID NO: 27922 - protein, 90 aa, Candida albicans
  UNSURE (42),(76): Identity of amino acid sequences at the above locations are unknown.
TAKTNNNTGRVYPKFLVRKTKFTINDTSININGNTVGNENHXNITFTSSVQHPGNSEIPNLYNVQDILSDSAFDDXIPTLTDNTKDQNNI

SEQ ID NO: 27923 - protein, 70 aa, Candida albicans
YLYVWIIILYNFNLRNFIFYIHLAIPHNSLLFKGTSFHNQQLNIHTYSYLFKFNEHYEIVVIQFIYHLYH

SEQ ID NO: 27924 - protein, 157 aa, Candida albicans
SSPIIATKSLSSRYGERSAAKKATAKLHDNMSDLIAYQEMTESSRKMKSYMDQLEGSLTPLKKRKHSEDQEEQEDEDEDENDEHGDEIEELSQSDFLKTKKKTQYHIIAIMSGCEQIIELSKSDIQKLRTIGIKIVNDIDNNISYYTGANGRIRSLA

SEQ ID NO: 27925 - protein, 70 aa, Candida albicans
ISTALGTENTQNLLIYDLLKSMDVNEILKSMENVVIEQYLELNNFPGIYSDSPRTELVYWFENLPKHPQF

SEQ ID NO: 27926 - protein, 77 aa, Candida albicans
  UNSURE (20): Identity of amino acid sequences at the above locations are unknown.
IINQQILSIFSTQGSRNLMXGRIRGPIFYTILCLFTNYLQHHTYFWNNRCSKFEQTGYDYRQDSIFPQPMVMYAMTD

SEQ ID NO: 27927 - protein, 76 aa, Candida albicans
  UNSURE (65): Identity of amino acid sequences at the above locations are unknown.
KQKKKTCACTWCALFSEQVEWENSIESYTIEWRGGNYKVKKRNVCLFHFYFFSYMLRVNNNKSKXSTSDARPSIRS

SEQ ID NO: 27928 - protein, 95 aa, Candida albicans
TNCSTPDNLLASFINCLETSISGAPPPAIKACCLTKHLITHKASCKDLSVSSRNKLLAPLIMTDTVGLIFLDFTPVISTILEPELTSSSIKFTNT

SEQ ID NO: 27929 - protein, 72 aa, Candida albicans
KGEREEEGGGGANENEKISRYKKKKKTHNEQRTQNYHQKSPIFFSKKSFQNDSYQYSSSQTKPINKLIPSSN

SEQ ID NO: 27930 - protein, 77 aa, Candida albicans
SLFFLPIPNLSSYYIFALNFTTFSFPFPSFFSFLFYSFFIFAFLSPNHITSIPIPPFSSVHHLSIILHSPPYSPYFF

SEQ ID NO: 27931 - protein, 102 aa, Candida albicans
RKVGDRKKEKRLRHMRDKYLVIMQAQKLEYRKKVASFPPSILSIYHDTDSLVNFNSLLLLCNIENYTHAQIRKVQNHHNPRHRRRRRPHITRSLKRDLSMYI

SEQ ID NO: 27932 - protein, 75 aa, Candida albicans
  UNSURE (13): Identity of amino acid sequences at the above locations are unknown.
PPHMRGLSSQAVXTTSFVLVDNPFRKNYSKSNDYLFAQQQHQQQQQQQQLQQQSSRPEKRLSVADVPNDWVWSSF

SEQ ID NO: 27933 - protein, 115 aa, Candida albicans
IRMSKNPFASALSQLEDKPRAQTPTHSSRAPPRPPKPSQKQPPPPSYEEAAGPEAAKKSYPREKEGRSEDSRERRRENSRSGHSRENGHSSHSRSYGREHGRRSDRDKECPQRRS

SEQ ID NO: 27934 - protein, 84 aa, Candida albicans
LRLSSGDFLQAKDFADEVNAHAPGATFDVPMGEFVNAASSIAVVVDHNVLSDSVDSFNDRGGAEQKAQFSSIELVGSVLLQCPR

SEQ ID NO: 27935 - protein, 125 aa, Candida albicans
HATLVANTTTSTTNKNVTDGSVSTTTTTTSMGTPKSSIFANPLTILSGSTNVNVNVNGGVSRNTIHIPSILNLDSNVHKRSFDELSEFIDYSEGCTGTGSDRKGELILDLSRTTSSYSDQYLMNV

SEQ ID NO: 27936 - protein, 61 aa, Candida albicans
KMEERKMEDEEDEELREREKIFFFVKSTSLLFIIFFFTHSSIIITHHHSFNYRFPFTETQY

SEQ ID NO: 27937 - protein, 263 aa, Candida albicans
  UNSURE (43),(255): Identity of amino acid sequences at the above locations are unknown.
SVPEIPRFNTAQVHPGPTKSETSVQFSTQERSDLPPPVPPVAXPIPWQAPPPPTIQKRTPPKVPPTRPKKSSHIRNSSQNSNIAQERSSKPPPLPSGPPPVPTSAPPLPNSIPPPPPPAPPAPTVPEELQNRNEGKVPTAPPLPSGGLPFLSEINAKRDDKNVISSAQSSNSAASPSVPGSLPPSIAKSSSSNASRVPNIPPAPPAPPAPPAPPIAPPLPAMGTSKEEKGTPKTNSSSIAPPAAGGSLPFLAQMXSTRRGRSI

SEQ ID NO: 27938 - protein, 66 aa, Candida albicans
  UNSURE (51),(52): Identity of amino acid sequences at the above locations are unknown.
MHLINQFLHLFLLLVFSIELIHQVLNSSVKIGIIAYGDYNNDSNKLGSVPXXWLELYFLNKVNSLS

SEQ ID NO: 27939 - protein, 153 aa, Candida albicans
FFMFDVIFILTTKSSNHFAYINQIMFQRQKVSPGEYLQEATLVKWVNTKLIEDTLSPQTPTSSCRDISETINNLTSDLHDSLVLTKLVNRLIYEVTLNPDHPMNKKANLYYLTPIYTKPTFKLQKLGNLLDLLKFLNLILSINVSSISPENIY

SEQ ID NO: 27940 - protein, 72 aa, Candida albicans
TDKHKQQQQQQLIIQTIYLSVSVYVSRVCCFILDHNNTNELQKGVTIRFKVNLEPNTVKQYVVVDHGNGKPA

SEQ ID NO: 27941 - protein, 119 aa, Candida albicans
LNTNIINFLYNNKQYETKETSNNHSINNKNRVGNRFILKRKRMLEIYYRVGFLVGWGGQLKKMSCLEKKKKHQAKTKKFDGHTTIKKERKRYQQTKHHHQEKKKSNNFCLPLLLLLFLC

SEQ ID NO: 27942 - protein, 86 aa, Candida albicans
TEKKKYSAKYNLYYSKPSQTPILLYLAQVSMLSKTVSKVACARPIWRRLYANSSNNVGSPESTTESKPKVNRFAKQYANQDQNRNS

SEQ ID NO: 27943 - protein, 63 aa, Candida albicans
KLYVLIWDNSRQFINIVNETNTNMIDNCMLNWGDRQNKIFNINEIQTSKLKQVNLYIYIYIYV

SEQ ID NO: 27944 - protein, 105 aa, Candida albicans
IFLLTNGRHSKLKIEEKNILWVFYFLRGVIKKACTLTFIQFNSAWLGLRSLGIFNNNMYVNLRLDLYVFTYIDTSSLIVSEFERWRTKRLVEEKFVSVLNFPNSS

SEQ ID NO: 27945 - protein, 72 aa, Candida albicans
KSKCRLFLSPPSKSKTPIKYFFLQFSVLNVFHLLKEKFMKGIIISFHNSKPITVIEDKIKWVHLAQTPQNHH

SEQ ID NO: 27946 - protein, 289 aa, Candida albicans
EFEIESFEQTSTPIRGETRKRRNAYESESIKHRSDDSVDSIFDNAYNSDVEDLGYYLKQVSGSISRPGSFSDKESSIFLTQADIEIFTKHDISNPKPPSDTFMESFLDVYEDQINEHTTDQQQLVDLEELQSEEEDNLSLNNQAGLEINDEIYQLELMLIKEKHNYMMKKQQRQIKHLQKLLNYQSQINQQLVNQMLVNNHHHNNYNNHSDNSDQLLPPFSMNYPHKKTNTNIDIDLYIDDNKSTVSSADSIMSKNLDIHNHNYQHIHNNGDDDGNNTVETRNCQVHPV

SEQ ID NO: 27947 - protein, 69 aa, Candida albicans
CISSNFNRVLDPCSIKPSRQLKKATSKVIKLIILNDLDPKYFNQITLGRKKVIILFISVVLQKLSREKQ

SEQ ID NO: 27948 - protein, 172 aa, Candida albicans
DPLDLLYDNSRIAMNEHLVTLYCPKCHDPMTKRIPITNDENTGFCDTDFQTINIGYENVKCYHGTPSHFTHDELRKLQLYCDMTNLKSLQGTHKYFSKVICPPKFTKRNPFLISDDVCKTLEKHWDINKSLDDILKSLNAKHRRELVRQRILLRHYLFFYQGTGRSAIYWGR

SEQ ID NO: 27949 - protein, 188 aa, Candida albicans
  UNSURE (145): Identity of amino acid sequences at the above locations are unknown.
IRRNLSPCGQDSNTVINRSSDSQISKNGSLRLANDIDKESLQEGFSIYSSKKLDDEYEGKPPQQPQQRLAASASFGNYKNGHNGILNFQQEYLSINEFLKESIRRSLMMANPATNFTPSTIPSPAQQPRVLSDVDSSDTSGMFGXGDAAGSMTPSSKSQKHRRNHSSSGGLNLKIVKPLKSAASLGIF

SEQ ID NO: 27950 - protein, 81 aa, Candida albicans
  UNSURE (68),(70): Identity of amino acid sequences at the above locations are unknown.
KMKIKTQDQKLTKSGQDIPLQTMSSRASSVSNLSQLDDFTRYVKETSLYDRIFHDLQERLPQRDQRGXCXSDRPGQFIPKV

SEQ ID NO: 27951 - protein, 63 aa, Candida albicans
VSEHKVAYILLYIKVIPPNHATASILHSVFCFTYSHNIPKNSPIHDHDFEVVFFSTGSEDPQL

SEQ ID NO: 27952 - protein, 140 aa, Candida albicans
RLIFHLEIQDFDFLPFYLFPLINLNTYMLRIFYFNRFQKLKTHNNRYQYFKVQTTNDIDKWINKTNNQRLGSTEHDCDLPNYAILNKNGLIELRSILEPGFFLYINESELEKAIYQYYQVTIKDFCVSYSFDRDLDMIQK

SEQ ID NO: 27953 - protein, 177 aa, Candida albicans
SIAARRIPMVKDEDACLMECDDLLEKYGQLPVLLELKTLLQTRHNVSTTINRLKKLQTIDAKLDMSLSLTELKNIYEEINSLNEKDNLLEKFNSKFNNKRDELMKQFQETLKENKWLNNSSIPNQALTLISKQFNELICLQSIVLIPAYPETWWGLDLLLEPIITRFNYHFNSVNKE

SEQ ID NO: 27954 - protein, 65 aa, Candida albicans
RNCVSFQARGEDVKIEWQTHHKTGGVIPELNSSSSLLWNVIKYQISNSVILDLLRKVLKFWNSSY

SEQ ID NO: 27955 - protein, 64 aa, Candida albicans
RLVLIAIISLPINNIVIILILMENNIVGKSIHIELITYPTESDDNDDDDSSSLLLVDIARENRL

SEQ ID NO: 27956 - protein, 172 aa, Candida albicans
PPFINRRVVSSTDGEEEVSKYSAPQIRTINKLLYFHQTTTTGTFNFNDHLLDSSPLKISYACGNSPNNPGIYSTTIINHNIDNEFSHRDLCSLVEVSIYGIYSIKSNGNTKFDEMSCFRRDDGNSPFYLNPDDFDNLLSNETITSKFIGLIMVHSINPNDHYMNIYAPDIII

SEQ ID NO: 27957 - protein, 70 aa, Candida albicans
FQFQFQFQFILNSAPFNPVHPFVTYIYTIMSEETVTIYDYEEVSKHRTHDDLGLVLNGLVVWPTGLDNPR

SEQ ID NO: 27958 - protein, 60 aa, Candida albicans
KHHRGPGRLVVKIFQVDQLPLSVNPNHSRLFFFVFFFWLTFYPFNKPHTIYSYHSDNIRN

SEQ ID NO: 27959 - protein, 201 aa, Candida albicans
  UNSURE (175): Identity of amino acid sequences at the above locations are unknown.
TRIFQPVANNKQYQGPQPPPPPAPQQQVPGQQQPQPQQGMPAGYLDPYRQYPPNTTFDPMALPPPPKINAHPQKPLPPLPHQMGGGQEQPSDNVSQQGLKIPDHAFTPKRRPEPLALQHSTHSNENISNEGNINANTNTNMNTVTSSITSDAVYPPPPTSATSAASLTPNLASPXSPLFHQSFSQTTLKSTPDPRGSTITN

SEQ ID NO: 27960 - protein, 64 aa, Candida albicans
RCYYRLSKLKSFLRTIFSKALFEKHKYIQNCFPIVYTSIAVGTQEKKILTSTKRKGKKERNKKN

SEQ ID NO: 27961 - protein, 251 aa, Candida albicans
  UNSURE (198),(229): Identity of amino acid sequences at the above locations are unknown.
DSCFPSSFGFNIYIYMNNSPTHIHFINYTTQLNSMLQSPFTYTSRKRRHSNVSSYPTVTTTSTTATTFTSTSTSTSTSTCTSTTHSSLNTNLPTPTSATAPIPSPKRQRKSKAAMSVLINKLSQMQSKIDLLQDCGLKCELQQLIEESVQELNQEPKSIHMNIPQKSFNEFILNTPKSSTPLTLSTQSTLIKSCREEXFHTIDDEEHNNLIENYQIFETPKEKIINYDXITTPPRAPRTESLLPGFEFPNI

SEQ ID NO: 27962 - protein, 68 aa, Candida albicans
KVDLKKRDEVRCLFFQFVIFFFYGERNALRLINEISRDIKGSRDKDKKDCTNYIWLTSSSKVNPTTRK

SEQ ID NO: 27963 - protein, 144 aa, Candida albicans
TNMAPPKRFWARLKLSPKFLGTLPEFPAYISKSRLKKLAQEERRSGTTSMTTLQRSSPAPEGGASATGPTISNYKVNVGLKEGSTSGLTINSITSGQYSLDKSGKPAKRWVKKPRLFKTFTGFKVTCVSFKPDFHQPARYIKGG

SEQ ID NO: 27964 - protein, 67 aa, Candida albicans
  UNSURE (29): Identity of amino acid sequences at the above locations are unknown.
VLLKRYLKKWDFQLFHRRIRNHCQQTSRXFPNHKYSHFHDGDESFILSGAEMSYSGSRMGLVLLSQE

SEQ ID NO: 27965 - protein, 100 aa, Candida albicans
  UNSURE (90): Identity of amino acid sequences at the above locations are unknown.
LSLMNCKNYELQSLGPLEDKALAEGKVAISEKLYNEILEENNMWKEKYAAVDLSTGDEHTLSTVKEILEEMGFSVIPQENSKSLPADKSXISESQIFPFP

SEQ ID NO: 27966 - protein, 93 aa, Candida albicans
NRVLSYFPIGPSELLDYMLPPDILQNGEFETIYFQTNPTYIKSPIHIPKSTIGKPDTVKIRHFFALLHPDLVVLGLQIFVYLQIYPHLVEKYV

SEQ ID NO: 27967 - protein, 103 aa, Candida albicans
PITVAEPNNALKINPTTPAIPCSAHTSNESSTCNKYLILVDKLQTIPAVIPNITDAHNGIIPEEGVAATKPEIHPEQTATIDHLFSKRKSNKHQDMAPKAPHK

SEQ ID NO: 27968 - protein, 94 aa, Candida albicans
LLATFLNNQPTNSPQSMTTNESIDITELRTHLYHSACKLNNLSLYQASKWCAEALNGLKDKQQPVTYPPLALDSDDLLDQRYVFTTGRPDRIRL

SEQ ID NO: 27969 - protein, 111 aa, Candida albicans
IYYYTLKETKSKKSRGNTQTTKTSEEKKANSTKRNKRTENKRENKEEKGRKEKHKRTQNKEKDTKTRTTEGNETRKEKKSNEGNKKDKKEKQNQKKKTEKEGEKERTKEKK

SEQ ID NO: 27970 - protein, 154 aa, Candida albicans
RQVAPVSSIPSASEILKKARAKNAASTTPEPKQEPVKSEDTKSEDTKSKETKSEETKRSEGITKNGVMAAGIPSWQLQHKEKEAQKKEAQKKSNQEQTSNNNNNNNNSSGIPVWQQAAAAATTSSVDTSKSEEEIKEKIKSVGVPAWQLNASTS

SEQ ID NO: 27971 - protein, 164 aa, Candida albicans
  UNSURE (153),(159): Identity of amino acid sequences at the above locations are unknown.
LLYSYRYNTPNDVSLFLQKLNDPTLTQPLPSSSQIQLIKRFKTLFGSNSIIDQQKLQNQNQNQGLTNIFANKKIDLNNLFNRNNPSHTVSDNIYLQYTPRLNEILAGLINPQPQSHQDGSLGLATLVPDKVKQQYGVHASDESVQDITMCSTXGMRPNXPKRAG

SEQ ID NO: 27972 - protein, 128 aa, Candida albicans
  UNSURE (100): Identity of amino acid sequences at the above locations are unknown.
LTGYLYLTIDTDTGYRYRYRYRCRYRCRYRYRCRYRYRCRYRYRCRYRYTLYYFCLEFHIPMKTKKAYNTIDNTGGFKDLFNDNTLIFRSQMKTYKNKAXTIKKCRRVYYIYIYILYGLSVEHILISH

SEQ ID NO: 27973 - protein, 147 aa, Candida albicans
VLYSSTTTITSYFCYHKQQLTNLISNIPAKIDIDVPLSIEQTNVDINVAVRELIDKKNVESIGLEYIIKREDKKGGNTDDNNKDDNNNDDSKKKSKPIYDQPGMRFVFALFAFVFLNMIAICIHHIYMKITNAANAYKTVDDEISPF

SEQ ID NO: 27974 - protein, 70 aa, Candida albicans
EIVMHSEENQRNSFRLVKMKSGFFICMLHLSTDCEESPPIKRVNKCMWFHILIKEKCLYMQIKQIIYDIM

SEQ ID NO: 27975 - protein, 59 aa, Candida albicans
CAVNIYTTKLEALRPYTIKALSYLNIHLQYHTDHTPLLIIQELPPRNWLPVFSIIDMSR

SEQ ID NO: 27976 - protein, 164 aa, Candida albicans
YSFTIPYRSYATFDYTRAPSKELVASFFDHRYVKINDWIFKDDQYRQSFLNYIRNHSSFSKDEIKEVVELHGRLVEVLDELQIGFQFLEKMWDAIFNRVVTDESVTALQKAIIEERDPLTNVLIRSARYDLYKKIITPRLNHSQMSINKSDDISPRGRKLPRMG

SEQ ID NO: 27977 - protein, 98 aa, Candida albicans
FLLVRTEKREPKNQKGRKKKKKRNQKTKTFYTTPISGENITTSLSFFIILTFQLFERNPLVMTTFWSQTINHQNGGVATATATATAATTTPTAGGTGA

SEQ ID NO: 27978 - protein, 78 aa, Candida albicans
LLFFYNSYRINIQLVLCVCVLTFFLSSYLSFIDCCYNLICLYLNLNHLIVIFNPKLHSHPINILYPNPIDFCITIDSF

SEQ ID NO: 27979 - protein, 67 aa, Candida albicans
FPAHIGRWIVRCPSVEDFGHALKLSILAALDETQLGDNTTNKVVYFKDNENQQMIGHFLNQFLIVYT

SEQ ID NO: 27980 - protein, 68 aa, Candida albicans
MMHDKIEQFIECYYVVMLDAQIITTTIPILNTTIVILLFFVEFEQWKANTRMKGAGGLAYCKIPFTKL

SEQ ID NO: 27981 - protein, 60 aa, Candida albicans
TKKPVSFKAFNTSAAALETNEDDKTVLAALLRKLPNEPEYESSLLVARFNQSFNYFPTTH

SEQ ID NO: 27982 - protein, 229 aa, Candida albicans
LKDWLKRATSNDDSYSGSLGSFLNNAASTVLSSSLVSNAAADVLNALNDTGFLVYATKRFLSSDSYINMTVALVNDIVSSSSVTIDTSGLNITELISGTLGNPKEIAALVGSLLSGDSSQTSQLSNYLGRYSGALSQILQDLEKKGLFAELNSYIFGDSTTKASATATATATATYSANGKNVANNNNKDAATSGSATSNSLTSSNTNSASKGCWCCYFVFTGGLEGPSL

SEQ ID NO: 27983 - protein, 242 aa, Candida albicans
NSIYGINFDPANNRNESNQLEMTQQPLQIQRQEPVSLQPHQMPEQEAVIYQPSNQDASNNRLILLSSPVQPQQKVSQTLELTNRNNITSDKTNANVSWEDDIEDSDPEFFKEMDINYDLVLASKAGKSKTDEIALDKHTNDEIISSVQIESVNDESTQVTNHHPHDVVIHQSKINLENHFNEKVENKKENETITYQHIDPKMISNGEDIDVLMSDIESDVSITNQVNQVTLPIQELKVFHHG

SEQ ID NO: 27984 - protein, 61 aa, Candida albicans
SSENPGKQETIEEELRNKDEKVTIYDSYSKQCLYLKHPSENAYKKTSHIKAAKIRNTNIRW

SEQ ID NO: 27985 - protein, 179 aa, Candida albicans
  UNSURE (174): Identity of amino acid sequences at the above locations are unknown.
KGGDLETVKNLAYEEGKKKGKLDGDNGAYGTSNQSSTNFSSNSNPVEEKEIHQKNKSAYNPGGVSAEFEENTTGPQATKSNAKSGSSGNTAAGVASGAAAGAGIAGVAASSGNAKQSSHDKSSSKGVYDISDAQGKDIPRNEIDHSSYKNTSSGLGSENLAAGCLHLRERARTXPKIDG

SEQ ID NO: 27986 - protein, 60 aa, Candida albicans
LVENKIMQGKQNIEEKKKSTEHFRAGSVVLQTSVKHLTTNFATLKGHGSVLVAHIIVNIK

SEQ ID NO: 27987 - protein, 137 aa, Candida albicans
YSLLYHKQEEQQTQTLPDSVLKKFCLKCGNLFIPGLTVSIRVVYTKQKIRKLRTRCLACRHSVFDDGLIQKQEKVEPIVKPAVVQSTNEENNVNNSKSKERRKKRKMNSLSNLLQDKKKKKTEESKLNSLDLMEFLK

SEQ ID NO: 27988 - protein, 88 aa, Candida albicans
SYIYIMAFGAPRGTGGPARGGRGGFGGGRGGTGGARGGGRGGARGGSKGGARGGAKGGARGGARGGIGGAICGARGGAKVVIEPHIHA

SEQ ID NO: 27989 - protein, 63 aa, Candida albicans
  UNSURE (54),(55),(61),(62): Identity of amino acid sequences at the above locations are unknown.
NLQPKILSTLEIYNYPTKSLKFLTKHNPAYHSILLLIIKATTLVILFNIPVTSXXTISPRXXN

SEQ ID NO: 27990 - protein, 207 aa, Candida albicans
  UNSURE (205): Identity of amino acid sequences at the above locations are unknown.
TTITILKITLIKHAVSSSLSLNTESFSIPKFQLKQLKFQSLVPLQKKNLRYGLNMISPAPASTYTSQTLQERHKYKLPLFQTGQVLANLIHANRESLKFMELEMINLNEICLILQQQYGFNNQCSKYFTALNLIKVDQCTDYPIIQLTHWLKNCKQIIYLNHFLSTFVVLQQNSSNNGIKEFKYHMSLFKYKRIFATRIAISRSXAE

SEQ ID NO: 27991 - protein, 111 aa, Candida albicans
NTSGSGTRSVFVKIDIAFHKSLDICTHLCKNNASINNRRRTSDECGNRNKTVPSVAGKGRLFIDFYLFNEGNFVYIIYSAFSTSKLSPFFCEANSFTFFTHRPEPIRISHP

SEQ ID NO: 27992 - protein, 215 aa, Candida albicans
KPKGKTKEEEQQQQQLPLSSGTAGGTSSNNSTGTVEKTLFFNKTKIKKEPASERSSLLDNASAGNASASSSEASLIQNAIGSDDHNGPPLTSAPTSSTLANASKRILSSKLILKKKSTSKLKEYTAAELEDMCTVSSLETPVATMISKGIEVEVDLASLDLPPDTKIFPTSIINNKNRTRGRKENKEADLSDTSKIHFCNLCQQSGTAGQEDPVW

SEQ ID NO: 27993 - protein, 81 aa, Candida albicans
  UNSURE (7),(12): Identity of amino acid sequences at the above locations are unknown.
HAPFYGXLRPLXTKLLQQVNLHIYIISIKMCQVFWLLIKIKVKIIITKRVAKPKVTMWVRIYCCRYRLTRAYRYTMLPMWA

SEQ ID NO: 27994 - protein, 61 aa, Candida albicans
IITTWIVLWNIAQLQSTPNFVALMIYFTTKFDAVYVTGAMPTWVTLYNDKPVLNGNDSNKS

SEQ ID NO: 27995 - protein, 61 aa, Candida albicans
LIRIVFSNINGNLYYNNFCLVVDNHIDGYILICKLGILSNYYNYLGSIGPLNDVINLIIIL

SEQ ID NO: 27996 - protein, 75 aa, Candida albicans
EDMWLSELNEHGSQGGDNRSPRIIVDVLTKNEIYLEQNNNFKLLVDTMDLLQPFPIGNILRPQAQSFVKYRCLVY

SEQ ID NO: 27997 - protein, 202 aa, Candida albicans
  UNSURE (183): Identity of amino acid sequences at the above locations are unknown.
QARILPAPVDEEGLYFRSPIFTNIHKSFHSPNDLLALRQCLSNYITADNVLYNGQLDNGNPCPFNRIGKSTLEMDITTNSIVNRTWLSPRELHDDFIEKAEFLEYKRAIELGSHKYGYKYDQDGQPRIYLSSLKQIYNDLKYQCRSRDSLFNVAADVLETENSSYFGTGSTNWSNQEQLNELXDYLKKLNGDVKLDSLKYSK

SEQ ID NO: 27998 - protein, 60 aa, Candida albicans
PPMISAGLSVPVGEDRQPIIFDYFLHSSKLATCPYLTKGIYPPILPTLNVSRYLQPAHIE

SEQ ID NO: 27999 - protein, 127 aa, Candida albicans
KSVGCNNTMAATAAAVAAAATVANQSYYTYQPMLPYYYGYPATPYQFANVLPGPPPPPPPPHPHPLPGAAAGGGSANSVTGDNNRNTAMSAAAATAATTTAYSNYLIPARGYPYYYFKLGVDKSNKE

SEQ ID NO: 28000 - protein, 70 aa, Candida albicans
EEREGREEKGGAGSKREREAGMSREGRERRRRERGGGKREGREAKRRVRGGRGTKNRGKRKKGEEEEEED

SEQ ID NO: 28001 - protein, 61 aa, Candida albicans
  UNSURE (4),(8),(15): Identity of amino acid sequences at the above locations are unknown.
SFGXLQLXVVAVPGXEDVCTSNKKRKEKIGFFSLFEGFSFSLSRNPLLSNQCCILSSFFLL

SEQ ID NO: 28002 - protein, 129 aa, Candida albicans
SINKQMLGSGKKKTINYVSYFYRKSAQYILYTYTAREILKQLKCMCIYVPNCLLNSKTSFKHSSISGLLSGLNGKHFFIQFNQFQVLAIVAFSVFHIFLCLDNQILIYHPGSISIFPNGRLPKPPANTI

SEQ ID NO: 28003 - protein, 139 aa, Candida albicans
LIITMTLTKYQRGDLIEGWNDCPVPLAHKEPLQHASLQQEIDTHKVIDILNKLFQCNIDLPEREIKHYETKLVNSVDKMSKSNINFVYHMCDRILQYQSQGSFSEVRNELKNEVIEYMMVHEGVSSWCSPLKKIITSIN

SEQ ID NO: 28004 - protein, 74 aa, Candida albicans
SLIIQAFLDTHKSMTSLINILLLLHPTVVTDAQLVEQIKLKIYQSHNNNNNNGWSHYNDDNRNSENQSLSTTTR

SEQ ID NO: 28005 - protein, 89 aa, Candida albicans
RTAIFLEALPSSYQWLLTVMSAWWAIGQIVVNLISWGLIANFSCPTIDNDVGSGSGSGNIICYKEDNKGWRYFLFTMGGLTLLMFFARF

SEQ ID NO: 28006 - protein, 219 aa, Candida albicans
FFLLKIEIIIDIIICIYVITLFPESRNAKARAKSRANSIISSRSSNSNSNSNSSTRGGVGVFIGTAGDAVDQLQELNNQQQSSSKSKLSMFFNIFSPLVILTYPTNLINENGKHRASQYRFVVISLIISQCINMMMIMTLGQILIQYGIFVFDWSSEDVGNLLTVLASTRAIILIVILPIFQNKILKKKFKFRVLKKQLDMIDYSLMLIGSSPRGWKDR

SEQ ID NO: 28007 - protein, 137 aa, Candida albicans
PYTCTYTYTSIPIIIVHTLMYSPTFSTRTESSSRTTSSTTKTPPLEMGLNKLNSNRNNGSHNNVFDATNMEHLYLMPVTDIHGLMTDKDDISLDIFKMYNKKYFPQEHQQQHQRISNLAWRISSKSSPRGSKLPRCS

SEQ ID NO: 28008 - protein, 134 aa, Candida albicans
  UNSURE (94),(108),(123): Identity of amino acid sequences at the above locations are unknown.
SCPLFSRNILNSIHPTNSLITKLPPYIIQQILEYVNQFDLINLLLTCSRLYLLAIEKLYKRITIVLEAEFPNKYKGDSHKYIIDNGMKYMDSSXIFKLNNLLKFIITXTKNKSIFQLIKYVVXDKSYDTFQGVK

SEQ ID NO: 28009 - protein, 63 aa, Candida albicans
IFYIYHLLNSLKGNDKLHKFLLFENVRQKMFKLLITELNQLNKPFIPPKLTNLFLLLNDLDDE

SEQ ID NO: 28010 - protein, 163 aa, Candida albicans
CFGKIQENQPSLSKIKPLRLSFTMHHLYYITERISRSSLDVDVGPLNIKSDNPNHEPTFISFMANKSRSSNRHFDSDNRSITSIDSVRSIVSNASFYWRSFRVSKDPKVINKDIKYLYSSFTKIPCLIFNPKTKINTISSYEEYPCDTSVPIQMFKNLQVLEI

SEQ ID NO: 28011 - protein, 167 aa, Candida albicans
  UNSURE (34),(36),(150),(158),(160): Identity of amino acid sequences at the above locations are unknown.
DGRQPLHQRLNQNQRQLVNQCHNQKNQNQKSIFXCXKGGGGGGVLEDKPAVEAVQPVQPPVEDEPVEAPAASSVAAVADASFSEPTASSIIDQQPQVVLPTTQQQVDSVGISFGSLSVDAGEPKEAAEVLQDETISEQVQPEQQQQSQQXPLPDGSLXTXGRACSPC

SEQ ID NO: 28012 - protein, 108 aa, Candida albicans
FFLELIFFWTRLFILFFHDFSDNTIIIVILFLTYLPLPTQTTMRIRFHLQRRQYNRFSGEDPILMEEISEDLSLNYLTDTFRLPNFETYLEASHSSTRRAGRTIAAGK

SEQ ID NO: 28013 - protein, 60 aa, Candida albicans
SPTAAIRPLRSEDSLCSLFNIKQKEFSKFDTTDFFCVYSIQVRQKKDVYTSTKILDSVCV

SEQ ID NO: 28014 - protein, 146 aa, Candida albicans
NLSMTPPIKSPSSSLVDYGKLSEQLMIAYTKDVLQRNLQKFHGEQHRQQFKQLLNQPVIKSIHPLSGIIVRYRHNNSELDKALDTIDLPKIFERLEIREKTNEDKNLDYDDLLVLELLNYLKNDFFKWVNTPDCPSCGIYQGCFKG

SEQ ID NO: 28015 - protein, 153 aa, Candida albicans
LLAIQDHLILNMSYPIDNLMDISFPEELFPQSTFSRSLLDIVSYDLSENELKKTNELEENHQVNTSINPSLSSSLSTSSTSSSSSSSSSLSFQNELIHLLHEYSENTTTISPSSATVSPKTYMNGYIKFVMDSANTSLEPIDTNENSTELTHE

SEQ ID NO: 28016 - protein, 69 aa, Candida albicans
  UNSURE (66): Identity of amino acid sequences at the above locations are unknown.
LQIKNDSIRNICNYLCKQNQFLITNNHISMLFKIDKYKTEAKAEAKAQTITLTKTNPYLVSAGECXICV

SEQ ID NO: 28017 - protein, 162 aa, Candida albicans
  UNSURE (162): Identity of amino acid sequences at the above locations are unknown.
ANFISMSSVLRNQDNPPTISEVSSTTKENTDNSNSKQEEKDNDKEISSTIENPTFVDDEEDNNPFSHHGEGLTSFMTANSFNEGPNTKSYKRTTKENNNSSSNNNRGDNNYDYDDDSLLLYNTSNNNKSNNVSRVNPMLKSTGEVFKTVNMNFESRVTKLLX

SEQ ID NO: 28018 - protein, 69 aa, Candida albicans
  UNSURE (58),(65): Identity of amino acid sequences at the above locations are unknown.
KHRFRSELKKNFHKKELQLPCIMSNSTASCHSQWLKMRTKREPLTINNNVFSDPLAIXYRPGRWXMQVR

SEQ ID NO: 28019 - protein, 215 aa, Candida albicans
  UNSURE (21): Identity of amino acid sequences at the above locations are unknown.
DAGFHAPWVTTNNKGINISAXKDKLNLKILQLYLISNYDFRNDNILNHLINEIHQQQQQQENKYINEIEILREVQSQPFVSYELFKTIIDHDFNNTYYQIINQLMKFDKLYRNIIENNIIKLTNYFTNIEIKTIHQLFELSPPPTSKTTSTTNNLPTIDIESMIFDMIIKNKFRNVTTIDQLNQTVSFNNDDNKNNNEDGIKYIGGLVNQAYMKI

SEQ ID NO: 28020 - protein, 81 aa, Candida albicans
  UNSURE (24),(64),(72): Identity of amino acid sequences at the above locations are unknown.
KNSTVFYVELICIVYTNPQKKRIXEWFQKRISWIIIRTKDSLFILLDFLTHSEYVVFWVIGLFXIRTTKGTXWKFPQNPPP

SEQ ID NO: 28021 - protein, 192 aa, Candida albicans
  UNSURE (19): Identity of amino acid sequences at the above locations are unknown.
TRIFYPRGEVSSSSSGGGXLINVHDFKIKSEFKINPILQDIIDGLLSNSFNLQLSSLLEIISKKKKLSISTDMTDMTDMTEGIIDIIIQYVLPLIDSNNKLINWLSSKIIFDIWKSQKSTTIKLKEVEVEVEEKEKEEKRILFRDTFVNSIQNRLNDIEKNLNLEEENIDELKIIINQIPKIYRSMINELLE

SEQ ID NO: 28022 - protein, 77 aa, Candida albicans
IVYLKHKVIWRLESFCIRKPSIKKKQVDNNLQDLPLYILNTIWMKFYIYIDISFSWSLLLKILKILVYSNNSLIIDR

SEQ ID NO: 28023 - protein, 69 aa, Candida albicans
RDLSLSAYNSTTSATEQLTSPKCYRCVSFALISSHFYRHYPLNKSTNLKVLTSLVINKTTIVNYIQKGF

SEQ ID NO: 28024 - protein, 76 aa, Candida albicans
YVQHRNARNVLTTKKYIISFIHGDKKKKAQYKKKYTHYLKQINKRQQNKTTIDHQQQHIYISIDKFPRLYFGIAYF

SEQ ID NO: 28025 - protein, 102 aa, Candida albicans
VISNATANNAIEISENAACLEQMAWRGNNTTARIVTSITWFTGTDAKIAHAISTTTTKYSFRISNPATTTALTELNAYDTADNIADGKYVPIDTKCFGDNIK

SEQ ID NO: 28026 - protein, 254 aa, Candida albicans
IYIHLIKYSQHNSIIILLMLSLGSMYLYKLNTDQGTKIGNAQQWLNNARYFQYLALKRIQPIIEQLINQEEENINGKFGVDLLISLVLLILYEFSNNCNKNWTIYLKLSKKLLTSTKFEIPQKKSINSLEYSILKFCLQFLDYQESMGRTACKDVNLFFLDYAQDEEEEEEEKSIEQQKQIDGTSNIIVVYKNVNLISWMGCDKQLMSIISDITDLSFERFKKSINEIDYNLLCQDMQKRLHDMKLNINKLATG

SEQ ID NO: 28027 - protein, 166 aa, Candida albicans
AKRGSCQPRGEELAHGCFKSKKIYNNNKNKNNKNKNSLEFIYDDFKTQIFENHYLQQMQVSDDSDVETGDIYSEDEDKQENLLKMDQLEKGDKTDDDDDDDDAYRLISALFYLNLLLQKGQSPNMIFRQLILFTIKYIECDNFTLKKLLSFKKAIGNKNNDTERVL

SEQ ID NO: 28028 - protein, 77 aa, Candida albicans
NLKNFTRKEKRLIYRIQDDVILQPFLQRKKKRFVLTKRSHFSFLFINCNLCYFLLDTMNVLNCWTIQLANKTHRADI

SEQ ID NO: 28029 - protein, 81 aa, Candida albicans
QNAANNVLNNHQMANPYPGEGVSNSDPPHGAVVPTVKYNRSFTRFGNSPSPNPPSRTRTYSLEWDQSIVSNALVSFLGCNF

SEQ ID NO: 28030 - protein, 255 aa, Candida albicans
LVRTCQPVVKNLDTVAGFPTLYAFSPANHDNPLMVFIPGGGHNARISYGGHPGSRSEDFLAHWLNKLGYGLLAISYPLQSQPDEIMAATSPEFRIRDWGLQAAEVTKTVIERHGLSPKVVLVAWSMGGRVLVPYTQAAKARGLTVELFVSLAATPGLAASRPNPPGIKMTSEGYAALDRMPELFLSQVREHNILESRVIIPDDVYLRDYYGCTPVGLFGFGINYSPQRGFVENPNTSPGRCRTPKNFRSVGLLNS

SEQ ID NO: 28031 - protein, 65 aa, Candida albicans
LMRIRQLRGEDVCCDHAHNGTGLGLDQSSPYQAPRRSTPDTPPLRNMELRARQHQATQERQVNRC

SEQ ID NO: 28032 - protein, 73 aa, Candida albicans
VLSQCYHVRTRWIFRFSSKIKDDVPGTVPGNPQILSNYHVSGAGETQGRIVGHHVTGRQAAVEVDPRYAMYEI

SEQ ID NO: 28033 - protein, 67 aa, Candida albicans
  UNSURE (34): Identity of amino acid sequences at the above locations are unknown.
YRWSTSQVESTVIIVYAPAKLLIDRSISGGGQPXQRTNEELSVLDLESSFRRNKVPILRYTPENVKT

SEQ ID NO: 28034 - protein, 79 aa, Candida albicans
RFFWIVANTGGQRKECEGDPVTNVLCLNERKEEEKTELSTRQKKEKKMKKEDEDLLPTQFMIFEKKKERKFKKISWRKY

SEQ ID NO: 28035 - protein, 70 aa, Candida albicans
CYSISGPRTSLAPLQSIPYALAAGHGQHPHSLTGLGTTTSHCQELNTTRRIKGVVMTTEVIVNRTLSFGV

SEQ ID NO: 28036 - protein, 116 aa, Candida albicans
HDSVLGDTLVKGHIRIDRAIVLRSIGDLRIFTPYDLSACRDETQFGDVDFDDGSLGQDSQLGVERVLRVLLDAQDGQLHGDAELRADKLSVGLQRKKLRGKDGRIVFTTSCKIRTS

SEQ ID NO: 28037 - protein, 132 aa, Candida albicans
TQGIMERLSGEMEVMGLLHVDGDAVRQRELLAEAPVVAVGRYVVSAENREGFDRVFEGMQHRLENATMPLPIFKGWRVEKEEGKEEFVLFTGWMEMQQHLDFAQSEGFQEYSKIKEYTDSSEVKHIVRWKVE

SEQ ID NO: 28038 - protein, 68 aa, Candida albicans
SVGDRRCVLDQPVDEVDYVGKSDRLNHSTEQVNEHHESHTEATESTKLLHWNQLDKIMDSGVDPPTTL

SEQ ID NO: 28039 - protein, 60 aa, Candida albicans
YSVLQGEYHRGPKSLISSIPICICNDCAWTAGFSEHLMVVIIGLSPGCLQSWCQVAATRG

SEQ ID NO: 28040 - protein, 73 aa, Candida albicans
GFLPGVCNHGVRWPPPGADHELFNHFDIGRGDAKLVPEPTLQALQRGSQGVLIRSACRVPSGLQPNDRMACNS

SEQ ID NO: 28041 - protein, 69 aa, Candida albicans
FVLFVLFVTPAPRFSGVTSCHLHWLCATPPAIGQVSSSGRPEKHLSSSNKMATIPSMTIRSSEMHFEYL

SEQ ID NO: 28042 - protein, 60 aa, Candida albicans
INSCDGDYLENTRISTTHAYKISLNYCSVYRFTGAMPKLFFKYCLNTKIKAPKQTKDNGY

SEQ ID NO: 28043 - protein, 62 aa, Candida albicans
LSADPASPVVKTCATQSCLGQIVHDRGKDYLDIEIPEVCKQAVARLLCLFPFFSASEPKNKN

SEQ ID NO: 28044 - protein, 93 aa, Candida albicans
DMNKTEEQTRQRISRLTNDSSESEEEIQLRMLAKRSSRSPVASPSQRSVSYSATVTASYTLTDELHDDRENWGETGTAATKTPLSSLIGEWRH

SEQ ID NO: 28045 - protein, 89 aa, Candida albicans
DGKCAAWSAPQSCSCLSPEGEFQTWCVHRDDDESPSDGTCEVGQESEQEGTIHFAFQHPHCGQSLQARNASSDYCWVESQLGRCWHVAW

SEQ ID NO: 28046 - protein, 79 aa, Candida albicans
  UNSURE (31),(45),(79): Identity of amino acid sequences at the above locations are unknown.
WLERSLLWLLLVHHAQYCEPDLRGFAKERPXQTWWRKDAGCSKNXASYCHLIESQSFRTCQHCYDRQIETRSNSRIPDX

SEQ ID NO: 28047 - protein, 62 aa, Candida albicans
RLSFHPAGEDDYKLLNMVIQNVTGEVSWKPVSRIIDSIFDKIDSTFVQAKRKAKGITKDQEL

SEQ ID NO: 28048 - protein, 85 aa, Candida albicans
YLSNCPIRLGITFPRGFFVYDIPVPTPHSREADRYRDERSDLILTEEGPLSTFEGIHFSPFQNALALIEKYWLFAKNWPEIETSL

SEQ ID NO: 28049 - protein, 64 aa, Candida albicans
QGSFFCQDKIRSLITISIRFSGMWSWNGDIVDKKTPGESDTKSDRTVGQVSKQQEPTSTQTVSM

SEQ ID NO: 28050 - protein, 82 aa, Candida albicans
YIICTTSEPYSPFSFLVCFTPSILLSPALSIPTIFDTDKSSSKKIVGSPDPQLSLLPIGVLTESRSSGTVLPLTDEHLQPFA

SEQ ID NO: 28051 - protein, 76 aa, Candida albicans
QRRGQKDGGSKADEERKRGIRFRCSTNYILGSRLIDARNEYNARRSLKRSEKNCKYEEREKKKTETKKHPTGLQVW

SEQ ID NO: 28052 - protein, 219 aa, Candida albicans
TVPYRGTCQPRGEGTSNSMGILQWSEQDECQARIQDAGLYIDWPNPYNLEPGLYIIVHTDYATRPGDIMDVIDDAYSAVTTRLKSQKFSNPRQPLPGRKRLFIHYELINQDDGTTNSFPTEVDLFEDVQRHLMHMFDQLEFGIKFDFPYKLGPVHVFWCDMVEWEHDLPTVTVEVFEETESDSQDAVSPTITVEMYEEVDSDSLGEAQDDDELPETAEQ

SEQ ID NO: 28053 - protein, 63 aa, Candida albicans
RMYKLYVNVTHSVEFENLHNCMSCRLFNKTIMSYGFNFKEEKNTFLTPFNRSQSTRSIFISVI

SEQ ID NO: 28054 - protein, 200 aa, Candida albicans
  UNSURE (164): Identity of amino acid sequences at the above locations are unknown.
SMSSESLPISSSSSSSSSNRKKANELVLEEAIVRSSIDTIDLITPKKLSNLSIKTTADDLQSNIEGYQEFLSNANTLFGERPLADYQYLWLETIYRLTFTLVKLKKSFSQLYLHAQPYEIESIGPKAIVLNAKLMQATEELSILMCEFFNNALSIVVAFENRVXSVIGTCLKLLLLEEMEDDRFDHISKGGITTDPGVFE

SEQ ID NO: 28055 - protein, 68 aa, Candida albicans
YPSIFDCKSSAVVLIDKLLSFLGVIRSIVSIELRTIASSNTSSLAFLRFDDDEEDEDDIGNDSEDIDH

SEQ ID NO: 28056 - protein, 61 aa, Candida albicans
YAKRGSCQPRGEDDEEMRKKVWRNDKDLHKVPLQKDISQSNPATSRKVVHHSEEFRWLGEH

SEQ ID NO: 28057 - protein, 282 aa, Candida albicans
ALCLPSSSDTTTSGTTIHSFKDQDTDYNKYNYLLEQFKLLFANDDADADADEIDNQYIKTKRDENTVNSIVSLLQSVEQSGLIPDIVLDITSSQTKMDNLANYTVGLLSTIMNGNTSSLLSGINIDLNTTEILNAVLNSGLLQSTAGGLILNNENNAKLADLVGEILGSPDNVWIGWLLVGLGNGEDLTVPFIANLVVNTTSKANTNSTNQSKIKSTVGGNNHNNKVEDVIIDKDSITDEDFNDYSGSLNEFLDNLAVKRDDSDNQYAGSLSSTTGAGRNRA

SEQ ID NO: 28058 - protein, 94 aa, Candida albicans
  UNSURE (83): Identity of amino acid sequences at the above locations are unknown.
ALGIDYARALLENETLRRPVEKALLHQTSPTLSYHRFEECSTQSPDKVPSPPDVLQIINAKAESANRKERACASDPATEIRDXRPTTWHFSNGC

SEQ ID NO: 28059 - protein, 287 aa, Candida albicans
  UNSURE (1),(25),(228),(264): Identity of amino acid sequences at the above locations are unknown.
XTKGPSSHTSGPSSTAAGTGAGLVXGSSAHSHSAEYDATHKSQLDSDLKKDLYSQGYTKGKSSHSSVPSSASDSHNHHRTVSGTSYNATKPINEGELPEPDLQDDVSGHDSRKSGAGIGAAALAGGAIGGGAAALATSDKHLDHNLKSELYEAGRSKGLAGSSQTEHADSTLDPKLQTTAYDAGQAKGLNTTGSTNLGLHPTLKEQLYNEGYTIATTGHPYLGKQDAXQDVGATRKISSLDPPQKPQLYEPSHNQRYSDSAGSXEIIPLVNPFKILKVLGLPSWKTR

SEQ ID NO: 28060 - protein, 74 aa, Candida albicans
ILASVFLQIEHGEEHGDCKERGEGHPDRSMSAYAVDGRVAGDTIDKGAVLIHARLKLLERQIAVCAIGERAVAV

SEQ ID NO: 28061 - protein, 79 aa, Candida albicans
RRVRTRMEAVDASKVSKNRHGDRNPRRRPLDQHTLILASFTSEGLRELAYPHITSSERKWKLTKPLTMILLSVATGCPP

SEQ ID NO: 28062 - protein, 89 aa, Candida albicans
  UNSURE (78): Identity of amino acid sequences at the above locations are unknown.
HFPRIRVLATISGMSTVEESRFVGIIDNGTGLLFSSTEKYGGVESARHRYAYIRSTAPSEPQQLFPETGGACGSGQLXLAGSIIRYPEK

SEQ ID NO: 28063 - protein, 85 aa, Candida albicans
LFFCIIISPKPNKSNHRIVMLSEEKDLSPHKISNILTKSGKNGETIVVIRMKNQLVREMSEEEFKLAAPKLYAKLKARQNPSNKK

SEQ ID NO: 28064 - protein, 69 aa, Candida albicans
LNAVMATKNKKLEEVSSDRYVNRNEGAKLVMGYIKDVCKDTKKRDKTKNLTSVTNTTKGKNNYTRLYGN

SEQ ID NO: 28065 - protein, 154 aa, Candida albicans
  UNSURE (10),(72): Identity of amino acid sequences at the above locations are unknown.
IIENYVTTTXSTAASDPNHKKMLLKSIYEKMMISVSDTNVSDSGSMSTTTTTTTATSNIKGGKRRGGRRATXTTTSTNANTTTTTNRNDKSNNGISNGGGINGNVKENFDHKYSEATLLAKIMKQFSGPKMAKPDELNHDLELMGIKTKWPITK

SEQ ID NO: 28066 - protein, 181 aa, Candida albicans
TGVNVHLDDDFINELIWNTALYSFRYSDIKPLSIANIQELLVTYLSLVEKLSFKAYMGITLVVSKVSRERGEKLFHIAESKFINQKTTLKEMVAYYMTQLYLAKSPEDLVHIFNIAIKKYKLSSKLWLVFIRKLSLFGLLDEKRATKILKKMVLTNVNINSDIITELSKSVSSPPGWKVMR

SEQ ID NO: 28067 - protein, 81 aa, Candida albicans
DVNFADPGQVSVGEDTSGKMLEYEVTTWVSVPSHGSSWGKNTRHERTNQKLLNIDSGHIIMNILKIIKLSNYQTIRTELIN

SEQ ID NO: 28068 - protein, 197 aa, Candida albicans
LRDLSNPVGQEYNTNRVLMSLRQEEAIAKVVKNIGGTVFVTQPAKSVESTFTNLFLEKITLLNSNEPYSSVQQYVSQSNDVDNEDAETEVVTVTTDGVTLLKNLPSFSSEVFQTNKIVSHIELNNFDYAIVTALRDLQYPVLVSQTSQEAYTYANLAYNLATKLNTSVFHFFAPTDYQSKKSIKLSEGVLLHKLDNL

SEQ ID NO: 28069 - protein, 81 aa, Candida albicans
NKTTFLLSLLLLSLQLILFEFPPFTLLKPSQISITTVSIIILNNITKQLKSIYTTVIKKKTISKLFFIFSFIILHFHQLAI

SEQ ID NO: 28070 - protein, 186 aa, Candida albicans
TGISPQHLFELISQDNVKWQQAMVKRFDMDENDDDDFSPFRNHDNHIKAILNLMLNQKPTNEKNSNPIFNYNLLEALDEVSNDMIEQLRESTSATLKGQSNNVDTANGTTDRDGVKGDVKSKRKLFDTTTNTLLNEKEIDFLRHKITQIIQHSEQTKMTQGFSLYDTKDEEGVHAGASDIVPHRDE

SEQ ID NO: 28071 - protein, 168 aa, Candida albicans
  UNSURE (167): Identity of amino acid sequences at the above locations are unknown.
AALISAIVTFPTYQTHVLGYGRYNSLDLTLLVATRALDTTLSSSLSKITPSSLSGYGDALLFIASCTCIMFCWFFYPEKLPPSYHKWITSAANMDIEFWEILRLVQQKKLVYGEHGPYEDYLGPYFEKHGRDPKRGNTVLTQPIECEAVHAFTTKSCELHALWRFWXG

SEQ ID NO: 28072 - protein, 72 aa, Candida albicans
RTRAMTFQPRGEELCELWKRVHFYFYIKESITYTYANKLRYYNLLGLNTTLPVNLPLAKSSRYCGKELKSAT

SEQ ID NO: 28073 - protein, 119 aa, Candida albicans
YHTTGELPMSEDEEDKHLKSPGGSSLNPRKLSDLQPSASSSLQTLDDTHSQPKSTTPSESTEYTSPSKSLKSFFFKNTLSSYSIDSIIEQPELEFQSHRHSTERTRTKKSSSIGSAQLS

SEQ ID NO: 28074 - protein, 88 aa, Candida albicans
KSSKTMLSITVEQYDYQTLTKSYMDIFNSQKFAQFLNTTQTGFAHSSSGIEFSVLMKTLFTSLCFCTIQLTLFCLLRPVFNYLYQPRC

SEQ ID NO: 28075 - protein, 66 aa, Candida albicans
FLVSGTTKTNNNNATSQTVSPQRISSVWIISIDFYSSNLKEITFCITRYTKYHTLDEKFVLLLHIR

SEQ ID NO: 28076 - protein, 104 aa, Candida albicans
TRSLSCCCTFANPYIRFSISHWSFYLFHFIFGNKNTSLKHNLLENGKFQRLIFSSFVMKINQTKPKNNRKKINRKEYAERHPILWFVYFGPKHIHHEVPIKAIV

SEQ ID NO: 28077 - protein, 76 aa, Candida albicans
LSVSNSPIQVQKIRGIVHIKSHCYASNLTIFSVFVITTQIKASSSLFKVLYYMLFVFMNFSTLHHRHSQYINTFSY

SEQ ID NO: 28078 - protein, 86 aa, Candida albicans
KRVVGYYYYLLKIEYATNQLNYLSLVIIMILIESYRVTLTTSTIILTIDYCQDLHILMLINEKFFLFYNSLMTFLLPIVVITSSRL

SEQ ID NO: 28079 - protein, 84 aa, Candida albicans
SRKDKILRRYDSMKFHLHHNKNNFSNVLLQDHTIIGQHKKNYNKAFYKNNAFFCLVAITNYRSIKPYFFYLEKELLVIIITFLK

SEQ ID NO: 28080 - protein, 62 aa, Candida albicans
LPNLELTQWFFIIHSFIFFFQPMSIFFFLNHTNYVVTQLVVEPVIEIFFFLFLSDSFFALNF

SEQ ID NO: 28081 - protein, 66 aa, Candida albicans
IGVMQILQWVVNAEPCELNYCGRGDNLTGISLLAAIGSKAKVVRDCKKKVTADQIKDVRNENLELV

SEQ ID NO: 28082 - protein, 70 aa, Candida albicans
RVICTISLESVVGFPGDFLPLLGFPVVVVVDDDNDDDVVVVVLASGATIIGVVCASFLAAPTWIINISKE

SEQ ID NO: 28083 - protein, 174 aa, Candida albicans
FKTKHLPLHKLMKNLVTNVPSVQLYKLTPELKYVTTTDNEVDSSSLVHHFNYFTEKLDSIWKQFNAKHQQEIQLYTPTNDKLFINELSQLIHLGEKINHTTGKSTDVFFFEVSSLLSIKRKIGSSSTTFIHAKEAMTDLLLKLSQTFDIIVVTFPQIQELSHLNKILPPLQINV

SEQ ID NO: 28084 - protein, 168 aa, Candida albicans
GSFQPRGEDYKTEAASLVWVEGRKLVHPFFTPKTLRVPPPAEFNPLFEKIENMKPTIIKFFLIPKEYDTTFMHIYPELQANRPIEDAIEPIEISENEFNSNESDDNEEEEEEEVVAQEEQPTSKAPSSEEPVGPNLFVIGLKGKDNKRVEVKVSPETQLRKLLSYYLR

SEQ ID NO: 28085 - protein, 61 aa, Candida albicans
  UNSURE (1): Identity of amino acid sequences at the above locations are unknown.
XAVLPFRGEEPTKVKNTNYIFDCLVIIFFISLPPTKVVFVSFFNFHLDLVAFFETKKNIVR

SEQ ID NO: 28086 - protein, 67 aa, Candida albicans
HHHHYQLENKITNPIQTYNQSYRLFNNTKQQQTTTYIIRFFNKQQVLHKQSYSHLSISPSGKCSPAG

SEQ ID NO: 28087 - protein, 169 aa, Candida albicans
PQQQQQKQPSVPTSSVPLQVSQKQNQQQQELPLPPQPQPQQRTAPSAVKQQQLMQMQPPPQQQQQQQRHQPLQQSPPTMPLQQQPVPPVQQVQTVPPPLLQPQTQLSQQQQQQQQAQLQMQVPRCYQYQNRPPSQQRQYSQTPQYNQPPPQQKVYALPPQQVVLTGGRG

SEQ ID NO: 28088 - protein, 60 aa, Candida albicans
RVTVSSWGISCHTTRLPCLMASKIFTKTNRVEGIQLLFIGRIRVTSSLVNLIRNRMERLQ

SEQ ID NO: 28089 - protein, 190 aa, Candida albicans
TFRPRGVKTNSIKFNYTVFSEGMIIWIINKIIETKSDNKLILLAIIDIISSLSIYGQAPKRCIPQMIKFLATIYGLSLDNSLSLSVWNCVKNLCHDHNYRDIMNSLCDNIHSSDINLYKIDVVEGIKPVYACTGSIKLIRNFQVQSGLSRNENIFEILQVQILNSFKMALNFGINIINSVFLDCIDRSLA

SEQ ID NO: 28090 - protein, 62 aa, Candida albicans
LSYTIIFRYLLPYILLNKSSVIVEFLHCKLSFVMCCKKTLIVWSCRMILFFFSLTPIQRSGR

SEQ ID NO: 28091 - protein, 64 aa, Candida albicans
ILLLQSNYSSWSILVTGKLPLMSDTTKASQKCFKKLIRGCFHLNYPWLSMRQIKIQFMHSIPFV

SEQ ID NO: 28092 - protein, 88 aa, Candida albicans
  UNSURE (16),(31),(50): Identity of amino acid sequences at the above locations are unknown.
IGSLITSGTINIPFSXNGQNGIYKSPKLPIXINPMGMEILKNILYEKPDXDGIHSVKNVDINTVFNVKIDQFDVELYYNGNIDVKLAM

SEQ ID NO: 28093 - protein, 63 aa, Candida albicans
IKASRGAARGGGRKEEAEEEDGAARRQRNPNSNHKNKRKSRRRKENKLHKTLKAKDAKKRKKQ

SEQ ID NO: 28094 - protein, 91 aa, Candida albicans
KKIDTYIELYSFRDNSLYIYMYISITYLYGVVSRNDKIGKLKQVEVRQGAGGGKKKQRRRMERHGGNGIQIQITKIKENLEEGKRTNYTKP

SEQ ID NO: 28095 - protein, 146 aa, Candida albicans
  UNSURE (9),(11),(26),(33),(46),(54),(70): Identity of amino acid sequences at the above locations are unknown.
IQVQKIPKXVXNIQRVATPLEGNYKXIGEVSGXNLTSNYMPGVFDXLDTQIFVXILLPYMLEKNETMNYXSNNNNSNNVNNNFNNNNNAGGVNNNSNGVAYNNNAANWPINNAEDGLNLEDLFGTLGNNGNGGTSSSNGLEYLDPF

SEQ ID NO: 28096 - protein, 130 aa, Candida albicans
KSKKCTCLLINIFNSCISFCNHCSLIMIDRSSCVNSVFSKPDMESLEDAFTISILALPYPIIARILYECWKERYKVCLILPIIYTCKQLYYGYKYMLYTLRPLVIINKSTKTTDKDCILCSAFIKLLQDS

SEQ ID NO: 28097 - protein, 98 aa, Candida albicans
  UNSURE (4),(6),(56): Identity of amino acid sequences at the above locations are unknown.
VLQXLXSSIISISYRVKAMLGGLNASSMVKGNWMAKINIKKVVVFSLNKKVVGQFXPSKLKLIFGVALLKCLKKIWLSNLGLSEIFQYQIFPTKYNIF

SEQ ID NO: 28098 - protein, 229 aa, Candida albicans
  UNSURE (218),(226),(228): Identity of amino acid sequences at the above locations are unknown.
TAHRTLKRQKSSVLNVGYYFTRETKLEIQQHQPQQQESRQQQQQQQPQHSQTHNIYDNDNYMNYNFPPTSNRPRASTTTGTTSTTHAGSELSHESHSVHTSHLKRTASSELDQPIPAMAPSSPLVSSAPYYYQQPCQQQNLSYHDHHHQQQQQQSTPQGQQLSQQTQLNLQSGVPPPLYGTSSSIPPGSTMQPSTSFAFHTSHSTYNLSFDSARSSNXVFLGSSEXPXV

SEQ ID NO: 28099 - protein, 70 aa, Candida albicans
  UNSURE (61): Identity of amino acid sequences at the above locations are unknown.
NVSLFQQEKDNHTLNSLNAVIQIIPSFIRSMYRLCEMVSYSAPFIFLRFPFFCVNSIKHCXYYIIILILQ

SEQ ID NO: 28100 - protein, 95 aa, Candida albicans
KKNIESFNYAFMYFRVLIAKKRFNAFCSLQDFTYVAFFIRILVNTIYRINSETEPRKTFGKRGKSKRLKRVCSSKSLKHVNHNQELVKEIYGSAK

SEQ ID NO: 28101 - protein, 130 aa, Candida albicans
  UNSURE (116),(119),(120),(121),(122),(123),(124),(126): Identity of amino acid sequences at the above locations are unknown.
PGISDPALPPWLKTTLINKESQQQSQQSSLSSENLFNDNFKSLEDLKDQLLNEYREDTNNNDWVLEIPDQLYHQSLINLCDVITENIDESFYRFDLSKILHWLNEKVLALQKYILXESXXXXXXAXLKFV

SEQ ID NO: 28102 - protein, 215 aa, Candida albicans
  UNSURE (199): Identity of amino acid sequences at the above locations are unknown.
YTNLSFVLIAFTFAQTVDVNPITDELSIRDTSGATSEEIEVANYLQQLVVAAGLDSQNLTKRDYPDNSLLTAAFTSLNRSGVGVQLVHTFATSSATQGTTINTVGQYVSVTGLTKLLTSANKSGLAVSIVMRFFINYSLVPGLWNVIVALWNNGVISLGKRGLLDLVGGIINGVQQSIINSLITIINSVTDLTQVCSSXEHFVVLDQTGWTDPSV

SEQ ID NO: 28103 - protein, 120 aa, Candida albicans
KMTINYESEGTITFKELRSLLLKEREEQRFSITNILEFVPTLTIENHKEKVGKYFRKLTLLFKERQLPMVANYIKFPQDPEEFPQDPWDDKINDFVLSVLEYTADDYVFTHGGRRHPRTQ

SEQ ID NO: 28104 - protein, 67 aa, Candida albicans
NFSTFSIESIASQIKKKTGNSKHLPTKNLAVSDIFKPMNENDEWRLFGPISEISYSLTKMHGFFLGS

SEQ ID NO: 28105 - protein, 117 aa, Candida albicans
RCLHSAGEDIQKEFHDVSDEEKSFKHNHDFIENISNLRHNDDDEEDIVEEELPNIDVKEKNSSLSPETPFMAKPENGALRLDDLIEVSCENEDDFELQNIPNPSLELPVSPSKHGFA

SEQ ID NO: 28106 - protein, 133 aa, Candida albicans
QQNFFTCERIFQVWPRFVEGCVDIWESVNKNDSSIPLQTRNLCFRKVTEGGKSPSTVVKLDIKFCHVRVCRKKKKISKKMWEKKRPLYSIFQGKGGGESACGIYNVYIFMCYGILKYIIFIWTINTAMTISFT

SEQ ID NO: 28107 - protein, 120 aa, Candida albicans
NLLFFSTYTHMTKFDIKLHNGRRTFSTLSNLPETEVSGLQWDRAIILIHGFPDVNTTFNKAWPYLEDSFAGEKVLLLAPKLRGYEKSSIGPESEYALPYLAEDVKAWIAEMSSPRVEVRV

SEQ ID NO: 28108 - protein, 270 aa, Candida albicans
  UNSURE (34),(267): Identity of amino acid sequences at the above locations are unknown.
GYLQRHGIAQVVCLTLISILDLIVLFTIHPHYVXISCGSLKLMFPVARFLTAVLCIAFIRDLELSVTSKLYVAYAQLLIHTIVGILFCIQLFYWFTRTMISIFQNLKNNQTNNDDVNQLLTVYDSLDDFQQQFDYKPLQPLPTYQIYSAATAITTTPLSIIDQMENPFIFGQSSGSCIMKQNGARNKTNAGKANKDKDEMEQQEEEEYLDANYYYRSRSEQVSKNIVDHELQTHSSNNSDVTSFEQLQYESNMSKLFFTHRSRQHRXILT

SEQ ID NO: 28109 - protein, 87 aa, Candida albicans
IGSILVSRADKTIVKAGRADYQFGTTFCSQRNRKHIMCKPQRLRSTSQQQQLPYTLSRYQNKIHCIRQFNLLPQNYLSFHLSYFSSF

SEQ ID NO: 28110 - protein, 68 aa, Candida albicans
  UNSURE (34),(59): Identity of amino acid sequences at the above locations are unknown.
KKSTQTESQSLKPIYAFQYDYSQSIIIIFGNWPXLVANTKIGIYVSAPEILLMPLSRAXKGVAHNSTT

SEQ ID NO: 28111 - protein, 70 aa, Candida albicans
ITQNLSTKIQNRKVQNEAVIGSEENELWFSTDSCFFQHFQNQLIAGVVGGKKINHIAKYKRARHCLDTVS

SEQ ID NO: 28112 - protein, 61 aa, Candida albicans
VRARLIKKGEIAFKSMNVDLSASIACAAQTFYIRKFLAGNETARKNRNNTTSTDKKIISFV

SEQ ID NO: 28113 - protein, 95 aa, Candida albicans
KILYHDKIYKSSYINQPLLYQIISTQHPMLPVKFSNQPPEQIISIYGFDKIGDHFILHFEHNDGTKSWGSVEFAKQLIPELTREYLSHPAHSHLH

SEQ ID NO: 28114 - protein, 65 aa, Candida albicans
  UNSURE (45): Identity of amino acid sequences at the above locations are unknown.
KLNNLRNFRSYTLRIGFNVGQITYLPENFKQEKNIFSSWVNFNFXPQTSESQISQRLSKSTPFDL

SEQ ID NO: 28115 - protein, 66 aa, Candida albicans
ARKKNYKKTQHTVFNFFKPRHTQVNSEHYVPRRTVRHLSPQEPRVEASTVSLHRGAEGPTWLGVAR

SEQ ID NO: 28116 - protein, 160 aa, Candida albicans
TLRGQKPDLLSTLVKKSSTTATGINTNKKAKHLQKASRTTVLNNKNKITRQLPGPLVGLYYDLYDDNLVDKYFDAKHEKIALGYPVTKAPYANDIVFIISFLSKFKAIIPTDNIGPQNFEYGLSLPLLEDTSDYETANYVKRHQEKEIFTTGLEGAALDG

SEQ ID NO: 28117 - protein, 187 aa, Candida albicans
  UNSURE (182): Identity of amino acid sequences at the above locations are unknown.
NYTSYTRESNFQSSGIMGMEQQVSSDGSYTYDEVSELSEDATTTEIRNIDKNENISPETRAHLYAAKIVQNRIPLFEQENQDLRENLHKKQLQEQFAGVTTNGDISMKSVAGKNGGLNAVKWKTRSQLKLNKGGSVVGDPEKITRGTVEPGVDLPLEYDQMIFDPETQQWQFSTGRKRDKCXANGGG

SEQ ID NO: 28118 - protein, 63 aa, Candida albicans
FHLTKSYINNSDFPFLSFPFHFSNIINIIAFSTRLIERIDRTAKTTKFVIFQCYKYVIPLLLR

SEQ ID NO: 28119 - protein, 128 aa, Candida albicans
TVLTIRGLKSRTHRFFKKGIRNFSCVLVICSHSSTINSNLHVLQPSSIGHNPYKPKAYLDQSHINGVPSSKDAQCVISPFPICKSCHIVHSFSFPSLGNKKSYTKIKRYNLNEETEHHRKKKEEVHAA

SEQ ID NO: 28120 - protein, 67 aa, Candida albicans
FRYVVSTTKSKVTVVIMLYQNCNHTLYFLFFLIEKEISFYLHQGVEDKTNRLNEESLKDLLVSNNIP

SEQ ID NO: 28121 - protein, 79 aa, Candida albicans
PRFKFQASERVERVVEAVREPVCVWVIPKNEQIEISKGTAKKKIKYTTLILPTQIHTLLNLRIIVESIYKKVLILSLDI

SEQ ID NO: 28122 - protein, 62 aa, Candida albicans
  UNSURE (61): Identity of amino acid sequences at the above locations are unknown.
TSELFFDNHLCKHNMEPTPLIELSDDEDEIDFNVNITRKPISLTTNDVFTTGWKVPRLGKXP

SEQ ID NO: 28123 - protein, 86 aa, Candida albicans
ATPNQQPTQEERNFFSAHEIRNFRQPTIKTVNNNTTTKKKIHAQSNSTLQQQQQQLLLLLLLLLPYFFHFFFFFFFKRGHTHIHIH

SEQ ID NO: 28124 - protein, 62 aa, Candida albicans
YRLPLLRFSTQVTSKVYAITNSIIYLLREEEKENKPLQINNQRKKKEIFSQRTKSEISDSQQ

SEQ ID NO: 28125 - protein, 160 aa, Candida albicans
KLEDKRIKPYLEEIKLSHWFESLAEYRFRFYNFKSSQFLSSTESDMSTQVNGNNFVRFNLCQKNSHEYIQKFERSFEKYKKAQNEPMSHIQLATNLVQDLLCTHEYIPTTEIWHYLLRNLGTLKLYNYQQIIYLSLFQYKHQPTILATPKESSPRVQIHV

SEQ ID NO: 28126 - protein, 154 aa, Candida albicans
RAWSFHRVVKTKTFRSISYNTKREAILNLPALSEQELVQRMMNTLVFVLNHTVTKENLFLDKSIRTKDESAKTGIDNEETKIVSTILKLDNEMPNDIKYDFKFRWFKEFTKQMDSIDPKVGPTKNQLEYLTEHYGYRMYYITLMRLNESAKLCL

SEQ ID NO: 28127 - protein, 211 aa, Candida albicans
YAVFPGRGADLRKEDKFEDLVLKYFIHEGYEDAAIKYSCRRKANANDIDQEIENRGNNRYDISGNKKDQISPPTSSLFIDNMNRLSNDKEFSDMVISYFNNPSGKHNNNESTDKHNNNNGGSESASFPDITDVGAINNRDKKTESGFATIKQRQEIKKLILNGDISQAIKQISQYYPMILDLNNLLHFKLLRLNLVEMIRNHKFNTKSSND

SEQ ID NO: 28128 - protein, 99 aa, Candida albicans
KFYNQQQDNTIITTMNTNEDNNSIDFEQIVGKNFLRKGGGEGNSVPSSLFHLSFHSLTSLITSVSLRLRPSTSFTPFSYSSLYIISVFSRSIFDLIGLR

SEQ ID NO: 28129 - protein, 114 aa, Candida albicans
RKRRKMMKEKKEEGIEERVGEKKVTNERERNKRRRGKEKKGWQGRDERRKKVGKERVRRRRRGEKGRGKVREEREVKKMMNEENERERRKRRRVIREKGKNKGDKGEKRGRGEG

SEQ ID NO: 28130 - protein, 68 aa, Candida albicans
HRETGLCPLVNSQGRILFPPPVVFAANSNFRYIIPWGVGSAIVLTGISLPVYTRTSILAAPTLRLFHG

SEQ ID NO: 28131 - protein, 186 aa, Candida albicans
LADYCPRGAHPIRVVPRPNLEMEYNFQQLKQEAELYYRAFVDSVMVKIEYGNELLNNKPGYSNTSRPNLSPMMSNDSVKLRQLYDVADDTFKTNLRSGKSMRDEDYYQCLIPFKKKSITGSSKYLGIISLSTIKEHYKIRYTPPTRFGKAPPPNDTELLIPLELNYFTESSTPLKNLPEIKAIDVE

SEQ ID NO: 28132 - protein, 270 aa, Candida albicans
  UNSURE (250): Identity of amino acid sequences at the above locations are unknown.
IPFNLSILKPSLSKRYLLNATLKTFQSKVILSNLIYTLIDLNEYDEALAVFTTYIDYLEKDEELKDGYIDDILSIIDTFSTCIIHFNPLKSFKSGNKFKHNDDSSVCQHLKKFVTLLQKYLLELQKLIDLTYDEEEDESDKVTTAAGDKIPLSFLYRKYNLNILQSDNTQFIELISKAWHATGYYYYYLSSYESSNQIILQNNISLVLKSYKNCLIVNSTGNVLYLSSYALTLANSGSLKTALKLCKSIXKKILIIVQDLEIGGNIVVQF

SEQ ID NO: 28133 - protein, 250 aa, Candida albicans
FIRQPMSSKVEIQTNPATATPSLSPPSSSASTSVPPSSNKSTTTTKNNDNDNNKTSAQQDEVPMKRKNSATSNGSSASTTPPKRHRTMSLNLGVPDNADVALRIVSPGLPPLINESMKTTVQLLKQIQQQQKNLIAARHGKDPEDEEHSQPQAQTQAQAQQPTSITIPASGNPNTQTVQLPPLNQRPAPKSPVYASDDSDLNRLSNVKKMKRMKCPPTIEYWVTVHALVLVIIPIILNWPPSLHPAPIRS

SEQ ID NO: 28134 - protein, 71 aa, Candida albicans
RFGGVVDAEDPFEVAEFLRFIGTSSCCADVLLLSLSLFFVVVVDLLDDGGTDVDADEDGGDKDGVAVAGLV

SEQ ID NO: 28135 - protein, 67 aa, Candida albicans
IDHYSNTNQVKISRSQSFMQSLLRVCDDQRILYRIELCHESTISRFPKQRKGRHGLEVITVSIIFNI

SEQ ID NO: 28136 - protein, 61 aa, Candida albicans
RVLGFSLNHMVGVYLISKYRTFNLQPSTKKKKTEQSNTKKLEKVWIHIHVYLRAPNYDKNC

SEQ ID NO: 28137 - protein, 60 aa, Candida albicans
FIASRSFNFISVLVVSDKLLNRYLAVFWQLFLVEQKISTDLPLECRFITSINLLFKKMSN

SEQ ID NO: 28138 - protein, 173 aa, Candida albicans
IRKNPFTPNTNTQASQDQPVDILRDLDTTTENSRLSNPLNNDNINAIEIPTTTNEQDTIPTAEIINRISEIIVTDTKRATQLYKGVKDKSKRKLIGSELIKFFRSDKVKLSIWRYIIDPRGRITRMSILNVLNSILDTSDKLNGMKIEILLNYLHKLSPTHNLHIERDGPSIF

SEQ ID NO: 28139 - protein, 62 aa, Candida albicans
VLREIIFLAAKRKKERKIENNRVAQPCLKSKKERRKDDARKERRKTENECPDNISKGLEVPR

SEQ ID NO: 28140 - protein, 132 aa, Candida albicans
  UNSURE (5): Identity of amino acid sequences at the above locations are unknown.
SNRPXSPITPIAIPVIRIDSNKLVPFGGVPLSDLYTKKFQQQEFQQRTHQKHNCPIQGKQTKHSMLATFPLYNTPISPESKGNVLKPGKDKDQNVNPGNDKSESPLLHLSNSKTASSSSSQSTSSSDVIIQI

SEQ ID NO: 28141 - protein, 63 aa, Candida albicans
TVVSICICVYKPKFGFVDIPDTDSWREVQKKIFFVCSDLIVTVETKKQREIYQASNFDICGAD

SEQ ID NO: 28142 - protein, 60 aa, Candida albicans
KQKRGEIKEERWEKKKKGEERIKRRENKKVENNKGRQWKEYKLKKKRNERENTMEISGKL

SEQ ID NO: 28143 - protein, 154 aa, Candida albicans
TIELKGINFYDNYLVIFFLDIFPLLELSLPNILMTKKGHEYIQLSTFSEHENEHEPESSSTTSSPPPPGIRQYEKQHEWNFTDLQLQFVLLRLGVISDEVYHNQNFSLLDPDIHISKEVEYMINKIDQLSISEAIEIIRDALADHNGDVNFLIE

SEQ ID NO: 28144 - protein, 69 aa, Candida albicans
TPITITYSANCTTHLIQEIFKEYKLFPQQKIRQSREKTKLKLNLADFNCMCVCACASCVNDPNGKSFFC

SEQ ID NO: 28145 - protein, 69 aa, Candida albicans
EILLNKQTKDFKLHNSYGKTCFEFQMIDARYQQNRTVANAEDNFTEVRNEKLLNSIKKFIPKGGLEVLI

SEQ ID NO: 28146 - protein, 68 aa, Candida albicans
  UNSURE (58),(64),(65): Identity of amino acid sequences at the above locations are unknown.
GRQLMQCICFIDLIRMDLIESLKRFKLMEITMMIIYIYIYIFVRSDIDKLLLPIRFFXQSAEGXXIPY

SEQ ID NO: 28147 - protein, 212 aa, Candida albicans
KYMIKMKTDEDKLITNDNLIESVPSNSNTNSNTNNRSNNDKPPRFKPSRKFLGNTKYLQFYNQFVQEFFTKCPKFSDLTSLIITTNGEIYNLPKRKKHNSRGRPRKNQNQNPQQNDFLNDDDDGNDIGGTLWTWQEKEIFFNLLNKYKTITAILNNQQDWLAFLPKKSMIQIITYYELLKNNYKTLQRQQHKQQQQQRPRQNFHHSAADQFK

SEQ ID NO: 28148 - protein, 160 aa, Candida albicans
ISKLNHNFLVMKLLPLSFSFLLFTFTFAKQLPVFDGKTYQSYSHSRNVYACRMHIHKTIKECSTTDIEDYGCMCTNKDAISTFIQCYAYFQKNSTQAIDFFVKYCDNYGNITTNIDQITDAYEDFLNNGSDTTTITNINNNNNTTNNTTINIFATGGRSA

SEQ ID NO: 28149 - protein, 151 aa, Candida albicans
  UNSURE (13): Identity of amino acid sequences at the above locations are unknown.
PPPLDLLGPAEEXNKIELFKLNSSVLELSEIPYLINLDELYSTNNLNYVIFLPQNGLTIKDSTTNSFTVEGFGTIGILNDWSLQRNDLLPLLNIFKANLIKTLKQSQSAAPKGVSTEITSFTPMDHKLAVFLPILGPIGISILNGLANFAK

SEQ ID NO: 28150 - protein, 71 aa, Candida albicans
LLVGVKSYILIRLHPFNTYSFLYDEIVSCTVGMNLCHKSTNTCYFVMNWQVVRVGEAPWWNDIILKLLVEK

SEQ ID NO: 28151 - protein, 65 aa, Candida albicans
  UNSURE (35): Identity of amino acid sequences at the above locations are unknown.
LGVQTIPKIKKRGKKKISSPEKLKPNKQKSKTNLXQNSYIISLLHLYTPTTKDNTFMYDNARSHT

SEQ ID NO: 28152 - protein, 154 aa, Candida albicans
  UNSURE (11): Identity of amino acid sequences at the above locations are unknown.
NQTNKKVKQTXYKTLILYPCYIYIRQQPRIIHLCMIMPEVTHKSNNIEEDEDKAYNQYVNSTDIPDDQIIESIFSERKTAHAEDAIDYEDIDELAEEEDVMEDLPRDEAINGLNSNNNNNHDKDDDDDDEFNRLLQEGQPELTNSSPGDGRKCV

SEQ ID NO: 28153 - protein, 89 aa, Candida albicans
QNQIKSIWQSIENDYKFGVANYWRCKQILYEIWNQREINNDNNNNNHNNNKSIIGNLGNQTNNKNDTEGDENLGFMSMIREYGIVLNLG

SEQ ID NO: 28154 - protein, 74 aa, Candida albicans
  UNSURE (58): Identity of amino acid sequences at the above locations are unknown.
TCYYSLRFGNEIDSKFLNTLKIQRQQHHQLILQTRNFKNIFTLIYVTIHVYCPRTRPXTHSLPFHYLPFLDYYA

SEQ ID NO: 28155 - protein, 87 aa, Candida albicans
SCPVLLKLNNFWMQSPITEAIKWPTSTFRGCAKGTCDALKHKIAEAPYEASIIGAWCRSLNILGLLNTPSKSATPANVPIRISNQMK

SEQ ID NO: 28156 - protein, 154 aa, Candida albicans
LSIKSSRRRRRRRNLESELESDKENDIVGVSKTVNLNQSTPIKKLPPTIPSAAPAPIPLRNKKLDNLACHADNILRMAIDSTIISSNSFTINSFEEDDDDEEGEGVDDHDHDHDFLQENSLIQLLKYKNSKRELRFKPPVIKFDINADDINSVL

SEQ ID NO: 28157 - protein, 61 aa, Candida albicans
STNYSAVPCRRIRKYFSSLEKASVYMGCHLTSSGSKSYASNKELYNFLNKLQKEPVHVVCL

SEQ ID NO: 28158 - protein, 63 aa, Candida albicans
LYFYNIYNYYSLSSTFLMIIFRDTQKEKNIGGHLPLFLNEEKFTHNYSSRFLFDLLVKSNIQV

SEQ ID NO: 28159 - protein, 65 aa, Candida albicans
CSQAKKIFLFIIYISSIFIKISYRLIVSTFVLTVVLSYFIHFVYSNYPMRFSYESKKNWFIILVC

SEQ ID NO: 28160 - protein, 65 aa, Candida albicans
ECTREGIVVIYIVEIKSVVKPETNFIGKETLITQLLSECVYLLILERPLIRSSPRELPVRDKLTA

SEQ ID NO: 28161 - protein, 106 aa, Candida albicans
SDFQKGENNLIFKMELKLSQRIKVICKSRHIHVCLCKILIVGKIGICSNNISFGIFVATKKKREESTTYKSLAGFLCYFILLCLTYTFTQTVTNKHNLYNERNIIG

SEQ ID NO: 28162 - protein, 218 aa, Candida albicans
  UNSURE (13): Identity of amino acid sequences at the above locations are unknown.
AIAVPSRPVVKTXTYRFVLAAVLNLDAKSGSNFDNSTDMLKQVLRFYGLSSDSTKNDRLSLEDDILYLARMVIDFVDIVGPEQSSLLYVNFVKQIYDKLGKNLDFRLSLILYEGLVKIFNEDKITMTKEFHRLRELVDSYIKDYPFKEVPIFPYRVTRYYGDMLVSRLKSHTPTRADELKILRVLQSGVKLETDQYTSVLKYFLEKFDDDDDYLHQVL

SEQ ID NO: 28163 - protein, 209 aa, Candida albicans
SPPAVKINVQAQSTHKQISLRIENLNVISTQLEGGNNYNYNNNNSDINGNGNFFINGNDQLDTPEFKRLSFIEDIARQVEKIDFENDDDNSTELKNKDHDHDRDRDRDHENTLTFDNALFSDINPNIEDNLLGLYSMTNSGIYNNSQITSTTTLENIINVLVLNLSRVKQQNSSLNSLSTFLENYYYNLNQLNQDYLDQQFQKKLLKIE

SEQ ID NO: 28164 - protein, 122 aa, Candida albicans
  UNSURE (1),(2): Identity of amino acid sequences at the above locations are unknown.
XXRDGIYTPWSSWVVATSSDSLQAKSDVIKNFIDAVNQGIHYYNEHVDEAIEYISSNLDYSAEDAKEWTKTVEFNSRIGKTPLDWDTIVVKTKDTLKLARVLAESDDVILKRLNSNVKKTNL

SEQ ID NO: 28165 - protein, 60 aa, Candida albicans
YYSSKKDKYHQRLLLFNVATKVVVNGTKRCINGNGTTNAGWCTIHSLKYMYIIICDKSTL

SEQ ID NO: 28166 - protein, 89 aa, Candida albicans
VWEMANYTDSVGGGGGDANETRELKRISRGLTVVEHVIIVHKNYLMFRKSYKNTLTMQKKKTLIMSFRTPFHCFYLYICIAIHFRITFY

SEQ ID NO: 28167 - protein, 71 aa, Candida albicans
ILIKLSLHDKKNPVIQLLYLKVLKCLINYLVDSKSSLPFAKPVVNTLQSLKLRQSSLLIEEVTTELLLVLK

SEQ ID NO: 28168 - protein, 75 aa, Candida albicans
VKTNGYGLNDLPTGRPKGSNYWSGVANLHFWIDFENGIGGFYAVQVLPFMDEYNIESYARFESEVYKVLGSQSKL

SEQ ID NO: 28169 - protein, 99 aa, Candida albicans
VVKVNYSAKINTARKKKNVQVNHFSTIHIMTSHSGYQRLDNVSSSSTVLPMHPPEYDDVHTPMEQFEIDDPQLPASGLLVKFANNFNTRILRPVTRIID

SEQ ID NO: 28170 - protein, 66 aa, Candida albicans
SIILVTGRNILVLKLLANLTKRPDAGNWGSSISNCSMGVCTSSYSGGCIGNTVDDEETLSSLWYPL

SEQ ID NO: 28171 - protein, 65 aa, Candida albicans
RHVYDDDNNNDGKTRSGDEQEIDEDDLDDEFEDEDDDDYYAEKYFDDGDDDDGGDDGGDDEAAFS

SEQ ID NO: 28172 - protein, 130 aa, Candida albicans
NKWKKKRSPIQITRSLNQIMITRKPYRIRSFINRSYSITRNPLKINRNISTHDRSTTNVLKRNQRRLKEFENNIQLAEQFKTHRQNVVEILKDEKNIDALFEKEVPIIVNDYEKLTEEMGALSFNDIEMR

SEQ ID NO: 28173 - protein, 156 aa, Candida albicans
CRRLVKTGQKKSTNFLSFRTVRSSPLRQPPIERKHGISLDEESIIQSNKSNSISDLPAISNAPSSPPASIRFRNTMRPTRSIEDIPKKESNTTADLNQQFSKHSKDHNFREFGFSRSSKLNTPKSRKLGFREFPEKNIVHSKVSDDVDTYSHSVLD

SEQ ID NO: 28174 - protein, 176 aa, Candida albicans
NDQRHNPLLKDISSQGGNLRTVPRSSSSSSSQKKKSSKKQRHNDEDDEENGGGEGFLDASSSRKILQLAKEQQDELEQEDEIQNKPSFAQSFKNQQIDSEEEEEEDEYSDFEEEEEVEEIVYDEEDAEVDPKDAELFNKYFQSNGEANNNDDDNSFQPTINLADKILAKIQEKESQ

SEQ ID NO: 28175 - protein, 95 aa, Candida albicans
TRKHDWTKRLSFVNSIAIYLYTCIYSLFFFLKRRAISTSRDICVYTCTCLFLDSSFFFFFHPKLALFSSNTPLQGQLLITFNLKSGYTHWDQKWA

SEQ ID NO: 28176 - protein, 69 aa, Candida albicans
LVFFFFDNLCGTKFLFVLTPFESAVPALSKSEFPFTGNNIFKLIKVSYQLIKSTNQPTNQICLNSYQIC

SEQ ID NO: 28177 - protein, 192 aa, Candida albicans
ILKRGSASLGVRHKSFTLFTEIIDNVPRILSPLRSTIFDILFGKNKFGTRYTKLICTSQEFRETYSLEIENYVNLVISYLGLNLVLITRNINDINVVNIIQMTMALSSIPGIPTEDENVSEQFIVFWEDFTETYIDDAEEMKPQFTADQDQANFIAKRNEILLEVSRIFFKKVLYYPAATKEFRLYRNSVAE

SEQ ID NO: 28178 - protein, 143 aa, Candida albicans
TYKQSLVYFPPMNRGIRPEFNEKLIELFENELREVRREDSLKIVKLHQEIEHLKLIIKSKDEEILRLIREEQPQPQQLLKRLLLGVKLENENTKELTFSFNKYSTHPSLTVSPIKRNKSTKNSKFVKPHDRKPTRDIDPPFVK

SEQ ID NO: 28179 - protein, 93 aa, Candida albicans
QFITINVSMFGSTTQSSTTPSFGGFGSTNNTNSSSLFGAKPNTTTAGTIGGGLFGSSTNQQQQPASGGLFGAKPATGTIQVFTRRWKEHRFGG

SEQ ID NO: 28180 - protein, 61 aa, Candida albicans
  UNSURE (51): Identity of amino acid sequences at the above locations are unknown.
ILFFSYSTFCSINLLIYQVLIIVLLSNSRKQFSILIITTFDINPPVFYHGXSPGSALNVKG

SEQ ID NO: 28181 - protein, 190 aa, Candida albicans
RQILLMDFELDELYALFPDLFESCGSAVATGSSSNSGSASAAGSSNSGISVNNYLPPLIIPGNDANNVHGNLGSNSLAEVSSPHNSAATPILSSNFALPSQTRTFKLRHNEELFNDDQLYSNPGTATTSCSNVNPFEYASAQLFKLNNIPSDHSKIPLWMKSTILDSNDAPVTTNINQGLHHGLEGPQLR

SEQ ID NO: 28182 - protein, 63 aa, Candida albicans
KINLYYQLNNNENRRMLEVVEIVTKYLVVVVVVVVVVVVVVVMVLVAGGNHEFKEESPHIHCV

SEQ ID NO: 28183 - protein, 237 aa, Candida albicans
LNMRGPFAPMVKICSLINYVGKLNTPSNTKILVSPKYSQYLKVNNYKPWLNQLYEQKHFIIFPAIVAQILSNYLTPTKYKLNQRYLSSLLKKYILNPIWINYKLGINYNRINWISLFRTYCFQNVVLMFGMGLYFFKSKLLDRLYETKHNKDEEKDYNTIIQDYLAYVAHKSNSFINLIFGVNLISILLISLTSPIFRLLTPKTTTNMNWIQLLYVNHLKLFFKSYTKIIRFATGCD

SEQ ID NO: 28184 - protein, 72 aa, Candida albicans
STLPIYICVLPNYKNYVIFRSSRFYLIILDLSSKLLIELKNVCPNKNQFNLNFESPSANHCPSIILISLIEE

SEQ ID NO: 28185 - protein, 172 aa, Candida albicans
KLISLAIFLLAVVVNGFRLRGLNYASLFMRDSRNELDEEDTNLLIKNLNINLNDDFYTALLNVGILAITLAGRSSYITELSLVNLEDETWVDRSIWERLKWAGHSSRNGTSRGVVQYLQENQLVGYGNVIAKPTQRLISGNYLGDYESSNIGGRTSVLKKRTLYLKDMIVGF

SEQ ID NO: 28186 - protein, 91 aa, Candida albicans
GKMARNNKQQKSKSKNNKKKQQNHRKNDDEGNELSIYDNKIREFEDGILDARKYLQSDDIKVDLDEEIDSDDALGSDDDYDVLNSKFSQTI

SEQ ID NO: 28187 - protein, 102 aa, Candida albicans
EVVSIRILTLLLQMESFFLSILYTEYYMLLFSFWSIVMVSYINELNPRQITNHIYFSTLKLLGHVMVFNFRLRVKNQSIAAIKRPPTVFTSGGARPGPYKRE

SEQ ID NO: 28188 - protein, 60 aa, Candida albicans
MDKWSVETVIRWSLFSLVPETSIGLEALEAIDKRYSLSYIDTEGKSYHYKKMSKQTSNQI

SEQ ID NO: 28189 - protein, 60 aa, Candida albicans
LLKSTKLIENESENKFLFFLFSNSSESYTRPQYNTYLVSLDLIELYAIDIYYVDSHIMWG

SEQ ID NO: 28190 - protein, 134 aa, Candida albicans
TKKKEIYFQIHFQSTSYFSITILQPLHLTTFCNLGDMSSALLIAKYLGAEKQAELIENLLVDIQKENTENDHNVEVLIELLDGFNLDKYPQFYNQILNFCNKKLLMENELEIILKFVYTIPYFTTSGQDPNNES

SEQ ID NO: 28191 - protein, 163 aa, Candida albicans
RRGYHGSHRGGYRTGRSKYPEDRYLVGGMLSLNKGSHYESSDNRYIPNEIGSKSPENRSHRSSTKDGRTPSGLSTPLSSSDKVSTPISIELINGSDRNTGVNNKDSEFPKLSHHSDFTLTIPFSRSINPQKNFMVINDSHTPKTDKGIQSRQIRSLPTAGRTA

SEQ ID NO: 28192 - protein, 259 aa, Candida albicans
  UNSURE (243): Identity of amino acid sequences at the above locations are unknown.
RCSFEPAGEDLLKLKGFEGFIKDVEHYISNSERYEKLCAMMDFEEEDEEVKYLILMSALEYANNEFNEEELIASFNQSTAGDNKLKEMTSSESSSAAPPPPQESESETETGVLNIEGDVIARPKNFGGNVSQIVSLQLINNTNETIQGGELLFEFFNQEQTIPVKVKNASDIKPGRVKYYHLGKLPEEFKKTDADNNVQLRITSPNAVLLGDYKFNTDSMLKLRIIAESKITTTLVVSGSTLXKEDSLILHQMMKFKSL

SEQ ID NO: 28193 - protein, 68 aa, Candida albicans
IVIDKFLSIEFNGNGNKLKLQIHNKAKNVINSLAFVVVVTIDSILLIKYKSLGKYKIIFFICRILAKL

SEQ ID NO: 28194 - protein, 179 aa, Candida albicans
  UNSURE (173),(179): Identity of amino acid sequences at the above locations are unknown.
VLWRLTWVSENNNALDSANLNEIIKRKGDFEPGTNTILFDNELGRNIRELLRQNKYSSNKETFPLWLREQMMYTFGQAGLWDRFWRDWQSILQSLNKTNERIYFWVVTALFLSKVDNRDALRHLFTKYWSNPSGASFVADYTTNNHQFNSDNERMALKNVLVQIGGTYRLHFXSDRSAX

SEQ ID NO: 28195 - protein, 118 aa, Candida albicans
LFAYLVIWSKLHVVFSLIINKLGLIIKNDDPNDLKIGSDVLFYFFFLSALFFNFFNFFFLQAYTSLALINTVYHTTRTCTRGEKENKYDNHHLLIYHHINKLYNLSLEFLVKSLHYLS

SEQ ID NO: 28196 - protein, 84 aa, Candida albicans
  UNSURE (73),(74),(76): Identity of amino acid sequences at the above locations are unknown.
FIYNQGKHNMQFAPDNQIGKELQQNLIQEIQRRFNKPADDAVDIAEYIIYLIVAKKSEQEIVAEVKDIADTSXXHXGRHAQKVE

SEQ ID NO: 28197 - protein, 151 aa, Candida albicans
PAVVKNGRFQISRREYNEESDNDFDANEWKGVESEGENQSSDDSEESSSDEDEEIQEDEEELAKQYKNQEVHFEKHFQFDKVIKFNKIQARFVGEDELELIIPNENKTVDDGNCVSIDVEPLQDDDSSITDEIDNTVAIPSLKEVEDVIME

SEQ ID NO: 28198 - protein, 93 aa, Candida albicans
LFAIQTNSNQISVILLSSSTNSRKGENTNIVKLLEGLFEPFILFIGNKVVIDLQKKNKLSHYNNLSCIQQETRTKLKHKVCKRLIEAITPHIV

SEQ ID NO: 28199 - protein, 168 aa, Candida albicans
TTTTTNGSINESNDTLQLSGTPSPKKPSTVSPVRGHQKSASISNSYSSASIALKAVVHEENRLHNHQQLQQYIPRSSTISTIVESPTKANTATETETKDGHKILLPPPSKDAQKLPHAAKKPRPTSYHPSSMSSALIHNNQNPTDVFKIRTPINFYHRRTDPYKLTEG

SEQ ID NO: 28200 - protein, 80 aa, Candida albicans
VFSIVVVCYTFDWERLYGSPAYKHNTLEKNEKKENKKNKYLKEHVIKLCCCCCCCCLRLIVVIDIFYILIVVSLLLLLLF

SEQ ID NO: 28201 - protein, 169 aa, Candida albicans
  UNSURE (3),(4),(12): Identity of amino acid sequences at the above locations are unknown.
IIXXGSGSYEVXTSAASAVAPGLPLTGGSNAYFAGMQQSPVGGSYVNYPAQVYQQYQQFQNQLQLQEQQQQQQQQQQKQQSQPQPSSQLVGNQNAQLESVARFRSGLPTGTQFNNGEQTPISGLPSRYVNDMFPFPSPSNFLAPQDWPSGITPTTHLPQYFVNMPLSGI

SEQ ID NO: 28202 - protein, 67 aa, Candida albicans
VSISVGCWFLIFKKKEGGKLKEKGKVIIILKIVVIKCIVCVVCMFVCFLFKKKKQQNQELIFRLLLQ

SEQ ID NO: 28203 - protein, 62 aa, Candida albicans
RRNDRDKIWLSLSFDELKLSILQNLEIKKFNGIADLLFNSLKSLADKRSLDKNNESTNSSSS

SEQ ID NO: 28204 - protein, 115 aa, Candida albicans
WKKIDIVTRDDPITGLKNPALSYNDDNDDQGDVFSDNRETLKLNDDYNYASIGQKDEYYLGDYSNSIVSEDWNKKKERKTTPHIILLLNNDLFIFKLTTTTICRFIVFIKTSFIS

SEQ ID NO: 28205 - protein, 179 aa, Candida albicans
LSERCPFRGVVKSNTQEKFKLIIGNYNIFNDEGILLPSTPKKLQKYKLPSTPLKSMKYTNNNNNSEIIKPNSNSLVAESESGLFQGMIFCITSIDGDRKLQLKSMIETNGGILWDKEIHELFLYHERERKRKRKQEQPLRKGSEISISLYLSCDLEIVETYNFIALISNNFCRSAKYVR

SEQ ID NO: 28206 - protein, 64 aa, Candida albicans
SNTNRLTPCFNTLNANGLPSQGLALTPTSFNMNDYVTFFTPSPGGAFNKNLLKTPDFHNSLLKK
